United States Patent
Connolly et al.

(10) Patent No.: US 9,968,643 B2
(45) Date of Patent: May 15, 2018

(54) SELECTION AND USE OF LACTIC ACID BACTERIA PREVENTING BONE LOSS IN MAMMALS

(71) Applicants: BIOGAIA AB, Stockholm (SE); Michigan State University, East Lansing, MI (US)

(72) Inventors: Eamonn Connolly, Lidingö (SE); Robert Allen Britton, East Lansing, MI (US); Laura Rae McCabe, Haslett, MI (US)

(73) Assignees: BIOGAIA AB, Stockholm (SE); MICHIGAN STATE UNIVERSITY, East Lansing, MI (US)

( * ) Notice: Subject to any disclaimer, the term of this patent is extended or adjusted under 35 U.S.C. 154(b) by 0 days. days.

(21) Appl. No.: 15/331,346

(22) Filed: Oct. 21, 2016

(65) Prior Publication Data
US 2017/0128501 A1 May 11, 2017

Related U.S. Application Data

(62) Division of application No. 14/405,496, filed as application No. PCT/SE2013/050646 on Jun. 4, 2013, now abandoned.

(60) Provisional application No. 61/689,338, filed on Jun. 4, 2012.

(51) Int. Cl.
| | |
|---|---|
| *A61K 35/747* | (2015.01) |
| *C12N 1/20* | (2006.01) |
| *C12Q 1/68* | (2006.01) |
| *A23L 33/135* | (2016.01) |
| *A61K 35/00* | (2006.01) |

(52) U.S. Cl.
CPC .......... *A61K 35/747* (2013.01); *A23L 33/135* (2016.08); *C12N 1/20* (2013.01); *C12Q 1/689* (2013.01); *A23V 2002/00* (2013.01); *A61K 2035/11* (2013.01); *C12Q 2600/156* (2013.01); *C12Q 2600/16* (2013.01)

(58) Field of Classification Search
None
See application file for complete search history.

(56) References Cited

U.S. PATENT DOCUMENTS

| | | |
|---|---|---|
| 7,344,867 B2 | 3/2008 | Connolly |
| 2008/0254011 A1 | 10/2008 | Rothschild et al. |

FOREIGN PATENT DOCUMENTS

| | | |
|---|---|---|
| EP | 1918373 A1 | 5/2008 |
| EP | 2604689 A1 | 6/2013 |
| WO | WO 2003105893 A2 | 12/2003 |
| WO | WO 2006110088 A1 | 10/2006 |
| WO | WO 2008028300 A1 | 3/2008 |

OTHER PUBLICATIONS https://www.nidcr.nih.gov/OralHealth/Topics/GumDiseases/PeriodontalGumDisease.htm retrieved Mar. 14, 2007.*
http://www.atcc.org/products/all/PTA-6475.aspx: Lactobacillus reuteri (isolated from human mother's milk . . . .
Boyce, F.B. et al., TNFalpha and pathologic bone resorption, Keio J Med. 54(3): 127-131, 2005.
Britton, R.A. et al., Probiotic L. reuteri treatment prevents bone loss in a menopausal ovariectomized mouse model, J. Cell. Physiol. 229: 1822-1830, 2014.
Iyer, C. et al., Probiotic Lactobacillus reuteri promotes TNF-induced apoptosis in human myeloid leukemia-derived cells . . . , Cell. Microbiol. 10(7): 1442-1452, 2008.
Kim, J.G. et al., Effects of a Lactobacillus casei 393 fermented milk product on bone metabolism in ovariectomised rats, Int. Dairy J. 19: 690-695, 2009.
Lai, C-Y et al., Preventing bone loss and weight gain with combinations of vitamin D and phytochemicals, J. Med. Food 14(11): 1352-1362, 2011.
McCabe, L.R., Probiotics and bone health—role of gender and intestinal health, NIH Office of Dietary Supplements, Grant abstact, publication date unknown.
McCabe, L.R. et al., Probiotic use decreases intestinal inflammation and increases bone density in healthy male but not . . . , J. Cell Physiol. 228:1793-1798, 2013 online.
Morita, H. et al., Comparative genome analysis of lactobacillus reuteri and lactobacillus fermentum reveal . . . , DNA Research 15: 151-161, 2008.
Scholz-Ahrens, K.E. et al., Prebiotics, probiotics, and synbiotics affect mineral absorption, bone mineral content . . . , J. Nutr., 137: 838S-846S, 2007.

* cited by examiner

*Primary Examiner* — Oluwatosin A Ogunbiyi
(74) *Attorney, Agent, or Firm* — Lynn E. Barber

(57) ABSTRACT

The present invention comprises a method for selecting lactic acid bacterial strains effective for preventing bone loss in humans and strains that have been selected according to the presented method. The selection method is based on the strain's capability of reestablishing an altered microbial community to normal and/or harboring at least one of four specific SNPs.

1 Claim, 3 Drawing Sheets

SELECTION AND USE OF LACTIC ACID BACTERIA PREVENTING BONE LOSS IN MAMMALS

GOVERNMENT RIGHTS

This invention was made with government support under AT005472 awarded by the National Institutes of Health. The government has certain rights in the invention.

FIELD OF THE INVENTION

The present invention relates generally to medicine, pharmacology and food supplements. More specifically the invention relates to selection and use of lactic acid bacteria for the prevention of bone loss in mammals.

BACKGROUND OF THE INVENTION

Over 40 million Americans over the age of 50 (14 million of which are men) are afflicted with low bone density or osteoporosis and its associated increased risk of fractures. Individuals with osteoporotic fractures are prone to depression, dependency and increased mortality. While aging is a major cause of osteoporosis, disease, disuse, and certain drugs can also cause bone loss at any stage in life.

The skeleton is a highly organized system that supports the body's weight, houses mesenchymal and hematopoetic stem cells, and serves as a calcium reservoir. The structure of bone comprises an outer cortical dense shell and an inner trabecular bone meshwork. Exercise can increase trabecular bone mineral density (BMD), and bone volume fraction (BVF), trabeculi thickness, and cortical BMD and thickness. In contrast, disease, disuse, and certain drugs (such as glucocorticoids) can decrease these parameters and cause osteoporosis in both males and females. Osteoporosis is defined by a reduction in bone mass (more than 2.5 standard deviations (SD) below average) and altered bone microarchitecture (such as decreased trabeculi thickness). With decreasing bone mass there is an increased risk of bone fractures. Thus, at the point of being diagnosed as osteoporotic, a patient has a 16-fold increase in fracture risk compared to someone with normal bone density. Fractures are associated with depression, dependency, and increased mortality (greater than 25% within 12 months for the elderly) and hip fractures account for over 50,000 deaths annually (National Osteoporosis Foundation (NOF) statistic). While osteoporosis is less prevalent in men, over 30% of hip fractures occur in men and mortality rates are greater for males compared to females. Currently, over 20 billion dollars are spent in the US and 30 billion dollars in the European Union to cover the direct costs of osteoporosis. Of even greater concern, it is estimated that by 2020 more than 61 million men and women in the US, over the age of 50, will have low bone density or osteoporosis (NOF statistic), and finding effective novel treatments is therefore a priority. In fact, one in three women over the age of 50 will experience an osteoporosis related fracture in their lifetime. Along with its associated increase in fracture risk, bone loss may have negative effects on metabolism and insulin secretion. Despite all the available treatments on the market, the number of osteoporotic patients is on the rise in the U.S. and worldwide. There are several reasons for this, including a lack of awareness that one is at risk early in life, an increasing elderly population, and patient noncompliance due to unwanted medication side effects. In addition, conventional bone loss treatments are not always effective.

Currently there are no alternative or natural treatments that can be used in place of osteoporosis medicines for people with low bone density or osteoporosis. Therefore, doctors are looking for new approaches to increase bone density in their patients and companies are working to improve pharmacologic bone therapeutic drugs.

Certain people are more likely to develop osteoporosis than others, some risk factors are:
Being female
Older age
Family history of osteoporosis or broken bones
Being small and thin
Certain race/ethnicities such as Caucasian, Asian, or Hispanic/Latino although African Americans are also at risk
History of broken bones
Low levels of sex hormones
Low estrogen levels in women, including menopause
Missing periods (amenorrhea)
Low levels of testosterone and estrogen in men
Diet
   Low calcium intake
   Low vitamin D intake
   Excessive intake of protein, sodium and caffeine
Inactive lifestyle
Smoking
Alcohol abuse
Certain medications such as steroid medications, some anticonvulsants and others
Certain diseases and conditions such as anorexia nervosa, rheumatoid arthritis, gastrointestinal diseases and others Menopausal women are prone to losing bone during menopause time due to decreased estrogen levels. Even during perimenopause (the period of 2 to 8 years before menopause) estrogen levels may start to drop off. Over time, too much bone loss can first cause osteopenia (low bone mass) and then osteoporosis.

Diagnosis of type 1 diabetes (T1D) is increasing in children and adults. While medical advances are extending patient lifespan, maintaining euglycemia remains difficult, even under therapeutic vigilance. Thus, more T1D patients (males and females) are suffering from complications, including bone loss. This means that patients begin aging/menopause with an already increased fracture risk. Once fractures occur, they can be difficult to heal, require extended hospitalizations, reduce the quality of life and increase mortality. Poor bone health also negatively affects the entire body. Postmenopausal women with T1D diabetes have higher incidences of osteoporotic fractures than women without diabetes. Children with T1D have lower bone mineral density than children without diabetes. Thus, maintaining bone health is critical for the overall quality of life of T1D patients and important for maximizing therapeutic/curative treatments involving marrow immune/progenitor cells since marrow cells and bone cells communicate.

Type 2 Diabetes (T2D) patients are also at higher risk of osteoporotic fractures than non-diabetics.

The two key components to strengthening bone and preventing osteoporosis are 1) attaining maximum bone density and 2) preventing bone loss during adulthood and aging. Bone remodeling occurs because bone is dynamic and constantly adapts to environmental cues to form or resorb bone. Targeted bone remodeling through the activities of osteoblasts (bone forming cells) and osteoclasts (bone resorbing cells) maintains blood calcium levels within a critical range while keeping bone strong at sites where support is needed. When formation and resorption activities are in balance there is no net gain or loss of bone, however when formation is decreased and/or resorption is increased then bone loss ensues.

Increased osteoclast activity results in bone resorption. Osteoclasts are derived from hematopoetic stem cells. These cells give rise to cells of the monocyte/macrophage lineage which, under the right conditions, develop into osteoclast precursors. Further signaling through factors such as RANKL (located on osteoblast surfaces) stimulate osteoclast maturation. Mature osteoclasts express enzymes involved in bone matrix degradation (including cathepsin K and TRAP5b).

Increased osteoblast activity results in bone formation, which can be regulated at several levels including 1) lineage selection, 2) maturation and 3) death. Because bone marrow stromal cells (BMSC) give rise to osteoblasts, adipocytes and other cell types, selection of one lineage (adipocyte) could be at the cost of another (osteoblast). This is supported by the reciprocal relationship between bone adiposity and mineral density recognized with aging, limb unloading, cell culture models, and type I (T1) diabetes. Osteoblast activity can be further regulated through death/apoptosis. An increase in osteoblast death will result in fewer bone making cells and therefore bone loss. Examples include the rapid bone adaptation to disuse/unloading, which results in bone loss, increased marrow adiposity, and increased bone cell death. Aging also increases bone cell apoptosis. Many factors contribute to modulating some or all aspects of osteoblast regulation (lineage, maturation, death) including: positive factors such as TGFβ, bone morphogenic proteins (BMPs), parathyroid hormone (PTH), and Wnts and negative factors such as cytokines.

Bisphosphonates are one of the most common treatments for osteoporosis. These compounds incorporate into the bone mineral and inhibit bone catabolism by osteoclasts and are effective at reducing fractures. However, many of these compounds need to be taken on an empty stomach and can cause gastric reflux and nausea resulting in reduced patient compliance. There is also concern about the length of time that these compounds reside in bone and their long-term impact on bone remodeling and strength. Selective estrogen receptor modifiers (SERMS) are another therapeutic treatment, but they still carry some concerns with regard to cancer. Hormone replacement therapy has been studied as useful in preventing or slowing the occurrence of osteoporosis, but sustained use of hormone replacement over many years may increase women's risk of breast cancer, may increase incidence of venous thrombosis (blood clots), exacerbation of pre-existing liver diseases and an increased risk of endometrial cancer as well as hypertension. Amgen has a drug under development (that is similar to osteoprotegrin) that works by modifying the RANKL/RANK system and hence suppresses osteoclast activity. Intermittent PTH treatment is an anabolic treatment, but this intravenous treatment is expensive and only indicated for severe osteoporotic patients. Taken together, it is not surprising that many people diagnosed with low bone density are confused about what to do. Many people do not want to take medication for fear of long-term effects. While weight bearing exercise and adequate calcium intake are two natural approaches, they cannot always overcome effects of disease, medications, and aging.

SUMMARY OF THE INVENTION

A primary object of the present invention is to provide a method how to find a lactic acid bacterial strain that may prevent bone loss, especially in menopausal women, in diabetics, and in osteopenic people, which includes for example young men with large energy intake and low exercise frequency.

An object of the present invention is to use products containing such strains in menopausal women to prevent bone loss.

An object of the present invention is to use products containing such strains in women who have had a hysterectomy to prevent bone loss.

Another object is to use products containing such strains in men, including but not limited to diabetic, young men with metabolic disturbance and osteopenic men, to prevent bone loss.

Another object is to use such product in combination with therapies for bone loss or bone formation in order to reduce the dose of such drugs to be able to minimize side effects.

Another object is to improve bone repair after fracture.

Accordingly, a first aspect of the invention provides a method for selecting a lactic acid bacterial strain for use in preventing or treating bone loss, comprising selecting a lactic acid bacterial strain having at least 95% identity to the genome of *L reuteri* JCM 1112 (SEQ ID NO: 1), and harboring an identical nucleotide relative to the genome of *L reuteri* JCM 1112 (SEQ ID NO: 1) in at least one of the following four positions: C in base pair 271 391, G in base pair 453 538, G in base pair 529 228, and C in base pair 599 338.

In an embodiment according to the first aspect, the method comprises selecting a lactic acid bacterial strain having at least 96%, such as 97%, such as 98%, such as 99% identity to the genome of *L reuteri* JCM 1112 (SEQ ID NO: 1), and harboring an identical nucleotide relative to the genome of *L reuteri* JCM 1112 (SEQ ID NO: 1) in at least one of the following four positions: C in base pair 271 391, G in base pair 453 538, G in base pair 529 228, and C in base pair 599 338.

A second aspect of the invention provides a method for selecting a lactic acid bacterial strain, such as a *Lactobacillus reuteri* strain, for use in preventing or treating bone loss, comprising selecting a *Lactobacillus reuteri* harboring an identical nucleotide relative to the genome of *L reuteri* JCM 1112 (SEQ ID NO: 1) in at least one of the following four positions: C in base pair 271 391, G in base pair 453 538, G in base pair 529 228, and C in base pair 599 338.

In an embodiment of the method according to the first or second aspect, the lactic acid bacterial strain harbors at least two of said four nucleotides, such as at least three of said four nucleotides, such as all four of said nucleotides.

A third aspect of the invention provides a method for selecting a lactic acid bacterial strain for use in preventing or treating bone loss, comprising selecting a lactic acid bacterial strain having at least 95% identity to the genome of *L reuteri* JCM 1112 (SEQ ID NO: 1), provided that the lactic acid bacterial strain does not harbor at least one mutation relative to the genome of *L reuteri* JCM 1112 (SEQ ID NO: 1), selected from the group of four mutations consisting of C to T in base pair 271 391, G to A in base pair 453 538, G to A in base pair 529 228, and C to T in base pair 599 338.

In an embodiment of the third aspect, the method comprises selecting a lactic acid bacterial strain having at least 96%, such as 97%, such as 98%, such as 99% identity to the genome of *L reuteri* JCM 1112 (SEQ ID NO: 1), provided that the lactic acid bacterial strain does not harbor at least one mutation relative to the genome of *L reuteri* JCM 1112 (SEQ ID NO: 1), selected from the group of four mutations consisting of C to T in base pair 271 391, G to A in base pair 453 538, G to A in base pair 529 228, and C to T in base pair 599 338.

In an embodiment of the method according to the third aspect, the lactic acid bacterial strain does not harbor at least two of said four mutations, such as at least three of said four mutations, such as anyone of said four mutations.

A fourth aspect of the invention provides a lactic acid bacterial strain, selected according to the method according to the first, second or third aspect, for use in the prevention or treatment of bone loss.

In an embodiment of the fourth aspect, the lactic acid bacterial strain selected is *L reuteri* ATCC PTA 6475, for use in the prevention or treatment of bone loss. This strain is available to the public at the American Type Culture Collection (10801 Univ. Blvd., Manassas, Va.), having been deposited there under the Budapest Treaty on Dec. 21, 2004.

According to a fifth aspect, the invention provides a lactic acid bacterial strain having at least 95% identity to the genome of *L reuteri* JCM 1112 (SEQ ID NO: 1), and harboring an identical nucleotide relative to the genome of *L reuteri* JCM 1112 (SEQ ID NO: 1) in at least one of the following four positions: C in base pair 271 391, G in base pair 453 538, G in base pair 529 228, and C in base pair 599 338, for use in the prevention or treatment of bone loss.

In an embodiment of the fifth aspect, the lactic acid bacterial strain has at least 96%, such as 97%, such as 98%, such as 99% identity to the genome of *L reuteri* JCM 1112 (SEQ ID NO: 1), and harbors an identical nucleotide relative to the genome of *L reuteri* JCM 1112 (SEQ ID NO: 1) in at least one of the following four positions: C in base pair 271 391, G in base pair 453 538, G in base pair 529 228, and C in base pair 599 338.

In an embodiment of the fifth aspect, the lactic acid bacterial strain harbors at least two of said four nucleotides, such as at least three of said four nucleotides, such as all four of said nucleotides.

According to a sixth aspect, the invention provides a lactic acid bacterial strain having at least 95% identity to the genome of *L reuteri* JCM 1112 (SEQ ID NO: 1), provided that the lactic acid bacterial strain does not harbor at least one mutation relative to the genome of *L reuteri* JCM 1112 (SEQ ID NO: 1), selected from the group of four mutations consisting of C to T in base pair 271 391, G to A in base pair 453 538, G to A in base pair 529 228, and C to T in base pair 599 338.

In an embodiment of the sixth aspect, the lactic acid bacterial strain has at least 96%, such as 97%, such as 98%, such as 99% identity to the genome of *L reuteri* JCM 1112 (SEQ ID NO: 1), provided that the lactic acid bacterial strain does not harbor at least one mutation relative to the genome of *L reuteri* JCM 1112 (SEQ ID NO: 1), selected from the group of four mutations consisting of C to T in base pair 271 391, G to A in base pair 453 538, G to A in base pair 529 228, and C to T in base pair 599 338.

In an embodiment of the sixth aspect, the lactic acid bacterial strain does not harbor at least two of said four mutations, such as at least three of said four mutations, such as anyone of said four mutations.

According to a presently preferred embodiment of the fifth or sixth aspect, the lactic acid bacterial strain is *L reuteri* ATCC PTA 6475.

A seventh aspect of the invention provides a composition comprising a lactic acid bacterial strain selected according to the method according to the first, second, or third aspect of the invention.

According to an eighth aspect, a composition is provided comprising a lactic acid bacterial strain having at least 95% identity to the genome of *L reuteri* JCM 1112 (SEQ ID NO: 1), and harboring an identical nucleotide relative to the genome of *L reuteri* JCM 1112 (SEQ ID NO: 1) in at least one of the following four positions: C in base pair 271 391, G in base pair 453 538, G in base pair 529 228, and C in base pair 599 338.

In an embodiment of the eighth aspect, the lactic acid bacterial strain has at least 96%, such as 97%, such as 98%, such as 99% identity to the genome of *L reuteri* JCM 1112 (SEQ ID NO: 1), and harbors an identical nucleotide relative to the genome of *L reuteri* JCM 1112 (SEQ ID NO: 1) in at least one of the following four positions: C in base pair 271 391, G in base pair 453 538, G in base pair 529 228, and C in base pair 599 338.

In an embodiment of the eighth aspect, the lactic acid bacterial strain harbors at least two of said four nucleotides, such as at least three of said four nucleotides, such as all four of said nucleotides.

According to a ninth aspect, the invention provides a composition comprising a lactic acid bacterial strain having at least 95% identity to the genome of *L reuteri* JCM 1112 (SEQ ID NO: 1), provided that the lactic acid bacterial strain does not harbor at least one mutation relative to the genome of *L reuteri* JCM 1112 (SEQ ID NO: 1), selected from the group of four mutations consisting of C to T in base pair 271 391, G to A in base pair 453 538, G to A in base pair 529 228, and C to T in base pair 599 338.

In an embodiment of the ninth aspect, the lactic acid bacterial strain has at least 96%, such as 97%, such as 98%, such as 99% identity to the genome of *L reuteri* JCM 1112 (SEQ ID NO: 1), provided that the lactic acid bacterial strain does not harbor at least one mutation relative to the genome of *L reuteri* JCM 1112 (SEQ ID NO: 1), selected from the group of four mutations consisting of C to T in base pair 271 391, G to A in base pair 453 538, G to A in base pair 529 228, and C to T in base pair 599 338.

In an embodiment of the ninth aspect, the lactic acid bacterial strain does not harbor at least two of said four mutations, such as at least three of said four mutations, such as anyone of said four mutations.

In a presently preferred embodiment of the eighth or ninth aspect, the lactic acid bacterial strain is *L reuteri* ATCC PTA 6475.

In an embodiment of the eighth or ninth aspect, the composition is for use in the prevention or treatment of bone loss.

In another embodiment of the eighth or ninth aspect, the composition is for use in preventing bone loss in menopausal women, women who have had hysterectomy, diabetics, osteopenic individuals, osteoporotic individuals, and individuals with metabolic disturbance.

In yet another embodiment of the eighth or ninth aspect, the composition is for use in improving bone repair after fracture.

In an embodiment of the eighth or ninth aspect, the above-described composition in combination with vitamin D is for use in preventing or treating bone loss.

In another embodiment of the eighth or ninth aspect, the above-described composition in combination with a hormone (for use in hormone replacement therapy) is for use in preventing or treating bone loss.

In an embodiment of the eighth or ninth aspect, the above-described composition is a pharmaceutical composition (optionally comprising at least one pharmaceutically acceptable excipient), or a food product or a food supplement (optionally comprising at least one food-grade excipient, as known to a person of ordinary skill in the art).

According to a tenth aspect, the invention provides a use of a lactic acid bacterial strain having at least 95% identity to the genome of L reuteri JCM 1112 (SEQ ID NO: 1), and harboring an identical nucleotide relative to the genome of L reuteri JCM 1112 (SEQ ID NO: 1) in at least one of the following four positions; C in base pair 271 391, G in base pair 453 538, G in base pair 529 228, and C in base pair 599 338, for the manufacture of a pharmaceutical composition for the prevention or treatment of bone loss.

In an embodiment of the tenth aspect, the lactic acid bacterial strain has at least 96%, such as 97%, such as 98%, such as 99% identity to the genome of L reuteri JCM 1112 (SEQ ID NO: 1), and harbors an identical nucleotide relative to the genome of L reuteri JCM 1112 (SEQ ID NO: 1) in at least one of the following four positions: C in base pair 271 391, G in base pair 453 538, G in base pair 529 228, and C in base pair 599 338.

In an embodiment of the tenth aspect, the lactic acid bacterial strain harbors at least two of said four nucleotides, such as at least three of said four nucleotides, such as all four of said nucleotides.

According to an eleventh aspect, the invention provides a use of a lactic acid bacterial strain having at least 95% identity to the genome of L reuteri JCM 1112 (SEQ ID NO: 1), provided that the lactic acid bacterial strain does not harbor at least one mutation relative to the genome of L reuteri JCM 1112 (SEQ ID NO: 1), selected from the group of four mutations consisting of C to T in base pair 271 391, G to A in base pair 453 538, G to A in base pair 529 228, and C to T in base pair 599 338, for the manufacture of a pharmaceutical composition for the prevention or treatment of bone loss.

In an embodiment of the eleventh aspect, the lactic acid bacterial strain has at least 96%, such as 97%, such as 98%, such as 99% identity to the genome of L reuteri JCM 1112 (SEQ ID NO: 1), provided that the lactic acid bacterial strain does not harbor at least one mutation relative to the genome of L reuteri JCM 1112 (SEQ ID NO: 1), selected from the group of four mutations consisting of C to T in base pair 271 391, G to A in base pair 453 538, G to A in base pair 529 228, and C to T in base pair 599 338.

In an embodiment of the eleventh aspect, the lactic acid bacterial strain does not harbor at least two of said four mutations, such as at least three of said four mutations, such as anyone of said four mutations.

In a presently preferred embodiment of the tenth or eleventh aspect, the lactic acid bacterial strain is L reuteri ATCC PTA 6475.

A twelfth aspect of the invention provides a method for the treatment or prevention of bone loss, comprising administering, to an individual, a lactic acid bacterial strain having at least 95% identity to the genome of L reuteri JCM 1112 (SEQ ID NO: 1), and harboring an identical nucleotide relative to the genome of L reuteri JCM 1112 (SEQ ID NO: 1) in at least one of the following four positions: C in base pair 271 391, G in base pair 453 538, G in base pair 529 228, and C in base pair 599 338.

In an embodiment of method according to the twelfth aspect, the lactic acid bacterial strain has at least 96%, such as 97%, such as 98%, such as 99% identity to the genome of L reuteri JCM 1112 (SEQ ID NO: 1), and harbors an identical nucleotide relative to the genome of L reuteri JCM 1112 (SEQ ID NO: 1) in at least one of the following four positions: C in base pair 271 391, G in base pair 453 538, G in base pair 529 228, and C in base pair 599 338.

In an embodiment of the twelfth aspect, the lactic acid bacterial strain harbors at least two of said four nucleotides, such as at least three of said four nucleotides, such as all four of said nucleotides.

According to a thirteenth aspect, the invention provides a method for the treatment or prevention of bone loss, comprising administering, to an individual, a lactic acid bacterial strain having at least 95% identity to the genome of L reuteri JCM 1112 (SEQ ID NO: 1), provided that the lactic acid bacterial strain does not harbor at least one mutation relative to the genome of L reuteri JCM 1112 (SEQ ID NO: 1), selected from the group of four mutations consisting of C to T in base pair 271 391, G to A in base pair 453 538, G to A in base pair 529 228, and C to T in base pair 599 338.

In an embodiment of the thirteenth aspect, the lactic acid bacterial strain has at least 96%, such as 97%, such as 98%, such as 99% identity to the genome of L reuteri JCM 1112 (SEQ ID NO: 1), provided that the lactic acid bacterial strain does not harbor at least one mutation relative to the genome of L reuteri JCM 1112 (SEQ ID NO: 1), selected from the group of four mutations consisting of C to T in base pair 271 391, G to A in base pair 453 538, G to A in base pair 529 228, and C to T in base pair 599 338.

In an embodiment of the thirteenth aspect, the lactic acid bacterial strain does not harbor at least two of said four mutations, such as at least three of said four mutations, such as anyone of said four mutations.

In a presently preferred embodiment of the twelfth or thirteenth aspect, the lactic acid bacterial strain is L reuteri ATCC PTA 6475.

DETAILED DESCRIPTION OF THE INVENTION AND PREFERRED EMBODIMENTS THEREOF

Figure 1:
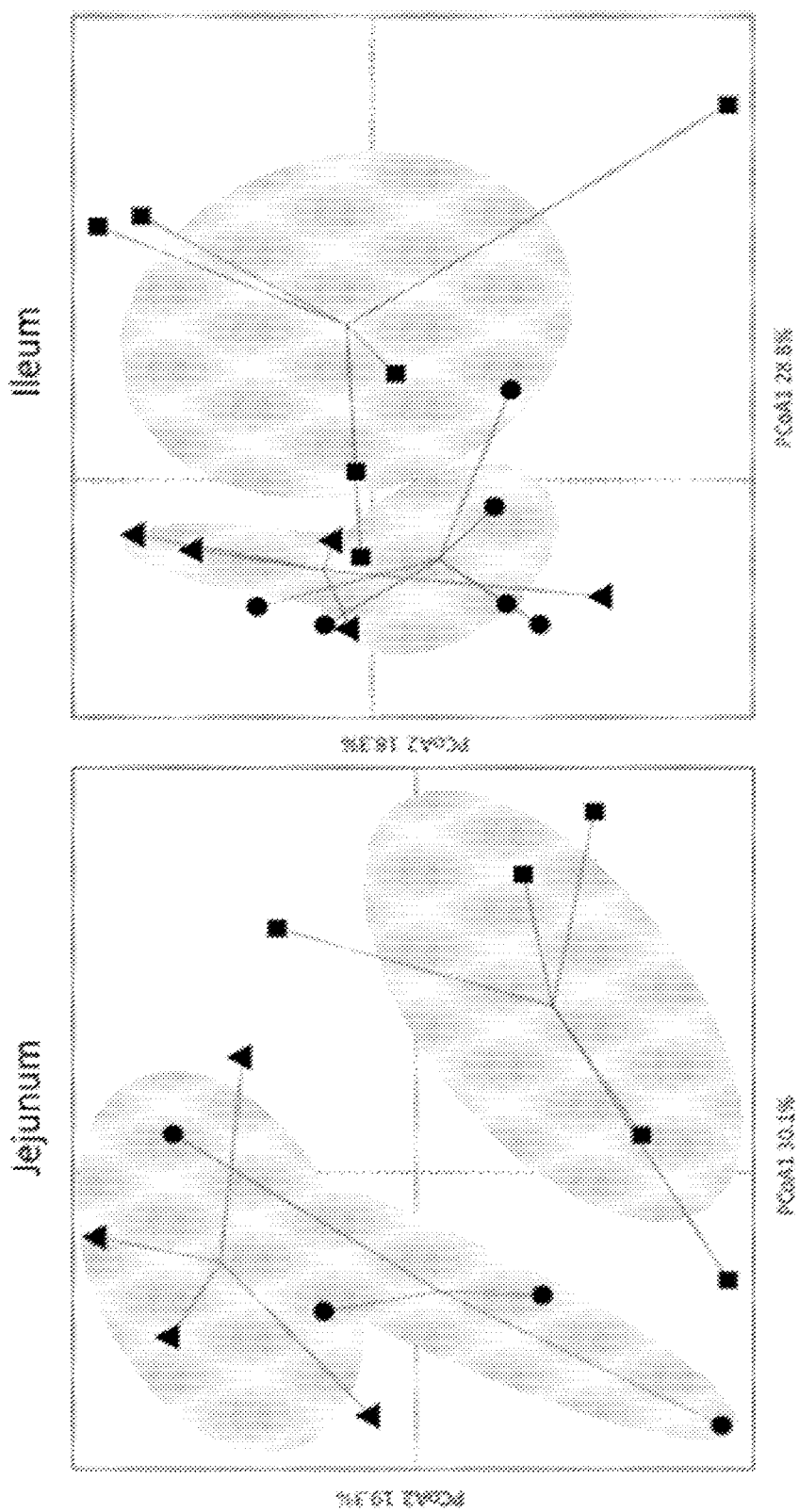
FIG. 1 shows microbial community clustering in jejunum and ileum.

No prior art either alone or in combination teaches how one can select specific probiotic strains that are effective for preventing bone loss.

The present invention herein comprises a method for selecting lactic acid bacterial strains effective for preventing bone loss in humans and strains that have been selected according to the presented method. Products such as foods, nutritional additives and formulations, pharmaceuticals or medical devices containing whole cells or components derived from these strains may be formulated as is known in the art, and generally include an ingestible support as known plus the lactic acid bacterial strain, or its derived component.

Based on prior art it would be natural to think that a strain's capability of preventing bone loss would be associated with its general effect on intestinal health or its anti-inflammatory properties, however the inventors have surprisingly found out that these properties are not predictive on the efficiency on preventing bone loss. Lactobacillus reuteri ATCC PTA 6475 and Lactobacillus reuteri ATCC PTA 4659 are two almost identical strains, which are both anti-inflammatory and improve overall intestinal health. It is natural to assume that these strains therefore would have the same effect on bone loss as well. However the inventors have shown that these strains do not have the same impact on preventing bone loss and based on this observation they have invented a novel way of selecting lactic acid bacterial strains, such as for example *Lactobacillus reuteri* that will be effective for treatment and/or prevention of bone loss.

Lactic acid bacteria specifically selected by the method presented herein may be administered to humans to prevent bone loss.

*L. reuteri* ATCC PTA 6475 and ATCC PTA 4659 differ in four SNPs, which are important for the bacteria's ability to prevent bone loss. These SNPs are shown in Walter et al. (Walter et al. *Host-microbial symbiosis in the vertebrate gastrointestinal tract and the Lactobacillus reuteri paradigm*; PNAS, vol. 108 p. 4645-4652), which is hereby fully incorporated by reference. For the SNP analysis, sequencing results were mapped onto a reference genome (*L. reuteri* JCM 1112, GenBank accession no AP007281, SEQ ID NO: 1). Seven SNPs were found in *L. reuteri* ATCC PTA 4659, and three of them were also found in *L. reuteri* ATCC PTA 6475 (SNP 4 located at bp 567 368, SNP 6 located at bp 968 088, and SNP 8 located at bp 1 358 460, referring to the reference genome, *L. reuteri* JCM 1112, GenBank accession no AP007281, SEQ ID NO: 1). The remaining four unique SNPs (for the purpose of the present text, hereinafter called SNP 1, SNP 2, SNP 3 and SNP 5, respectively) constitute the genomic differences between *L. reuteri* ATCC PTA 6475 and *L. reuteri* ATCC PTA 4659. Said four SNPs are located at:

bp 271 391 (SNP 1),
bp 453 538 (SNP 2),
bp 529 228 (SNP 3), and
bp 599 338 (SNP 5), (referring to the reference genome, *L. reuteri* JCM 1112, GenBank accession no AP007281; SEQ ID NO: 1).

SNP 1 is located in a gene coding for a conserved hypothetical protein (*L. reuteri* JCM 1112: http://www.ncbi.nlm.nih.gov/protein/183224225), SNP 2 is located in a gene coding for a chloride channel protein (*L. reuteri* JCM 1112: http://www.ncbi.nlm.nih.gov/protein/183224386), SNP 3 is located in a gene coding for an ATP synthase gamma subunit (*L. reuteri* JCM 1112: http://www.ncbi.nlm.nih.gov/protein/183224455) and SNP 5 is located in a gene coding for a DNA mismatch repair protein HexB (*L. reuteri* JCM 1112: http://www.ncbi.nlm.nih.gov/protein/183224511). The SNPs involved in this invention are the ones that match *L. reuteri* ATCC PTA 6475, the sequence of which has identical nucleotides as *L. reuteri* JCM 1112 in the positions of SNP 1, SNP 2, SNP 3 and SNP 5). Listed below are the nucleotides that differ between the strains *L. reuteri* ATCC PTA 6475 and 4659:

SNP 1) a gene coding for a hypothetical protein, where nucleotide 267 has been changed in ATCC PTA 4659 from a C (as in ATCC PTA 6475 and JCM 1112) to a T.

SNP 2) the gene coding for the chloride channel protein, where nucleotide 373 has been changed in ATCC PTA 4659 from a G (as in ATCC PTA 6475 and JCM 1112) to an A.

SNP 3) the gene coding for ATP synthase gamma subunit, where nucleotide 296 has been changed in ATCC PTA 4659 from a G (as in ATCC PTA 6475 and JCM 1112) to an A.

SNP 5) the gene coding for the HexB protein, where nucleotide 1966 has been changed from a C (as in ATCC PTA 6475 and JCM 1112) to a T.

In the selection method of this invention, strains are sought that, in at least one of these SNPs, harbor the same nucleotides as *L. reuteri* ATCC PTA 6475 for the above mentioned SNPs.

The microbiota plays an important role in bone loss; many patients suffering from bone loss have a disturbed intestinal microbiota. Lactic acid bacteria that are able to reestablish the normal microbial community in the GI tract are surprisingly more effective in preventing bone loss.

The present invention discloses a unique method of selection, selecting strains effective for preventing bone loss. The ability to reestablish the total gut microbial composition is surprisingly also important for the function in preventing bone loss. The inventors have found out that strains capable of reestablishing an altered microbial community to normal and/or harboring at least one of the four specific SNPs are effective for preventing bone loss.

The ability to prevent bone loss is unique for certain strains and is not at all general for all lactic acid bacteria. When selecting effective strains it is not sufficient to use anti-inflammatory capacity as selection criteria since the inventors clearly show that this effect is not dependent on anti-inflammatory features. *L. reuteri* ATCC PTA 6475 and *L. reuteri* ATCC PTA 4659 are both anti-inflammatory strains, but *L. reuteri* ATCC PTA 6475 is much more effective when used for prevention of bone loss, and *L. reuteri* ATCC PTA 4659 is not selected according to this invention. Specific lactic acid bacterial strains selected according to the present invention may be used for preventing bone loss in general and the embodiments below are not intended to limit the scope of this invention, but to exemplify preferred embodiments.

Vitamin D is crucial to bone health and people with low levels of vitamin D have lower bone density or bone mass. People that do not get enough vitamin D may lose bone, since vitamin D is required to absorb calcium. The inventors have seen that an altered microbiota will lead to vitamin D deficiency and bone loss. Administration of lactic acid bacteria selected according to the present invention will reestablish the microbiota and thereby increase the intestinal vitamin D absorption and restore the levels of vitamin D. It is also an option to combine vitamin D with the selected strains in order to get an even more efficient method/product for preventing bone loss.

T1D patients suffer from complications such as bone loss. Patients suffering from T1D will as a result of the condition have an altered microbiota. Administration of lactic acid bacteria selected according to the present invention will reestablish the microbiota and prevent bone loss.

High bone density during youth and adulthood can help prevent diseases like osteoporosis later in life. This is due to the fact that high bone density will allow a higher degree of bone loss before reaching a bone density within the osteoporosis zone. Thus, it is an object of the present invention to prevent bone loss by administering lactic acid bacterial strains, selected according to the present invention, to young and adult people. This will help individuals to obtain maximum bone density to prevent osteoporosis from occurring later in life. Administration of lactic acid bacteria selected according to the present invention prevents bone loss in healthy recipient as well as those suffering from bone loss.

Administration of selected lactic acid bacteria may be combined with hormone replacement therapy. Such a combination would make it possible to reduce the amount of hormones and thereby reduce the side effects, such as reducing the risk of cancer.

Lactic acid bacteria selected for preventing bone loss would preferably be administered to menopausal women and osteopenic men who are prone to develop osteoporosis, and administration of selected lactic acid bacteria will prevent bone loss and thus preventing low bone density and osteoporosis.

The inventors have seen that estrogen depletion alters the gut microbiota. Treatment with lactic acid bacteria selected according to the present invention will reestablish the microbiota in people suffering from decreased estrogen levels, including but not limited to menopausal women and women who had hysterectomy, consequently preventing bone loss.

Lactic acid bacterial strains selected according to the present invention may also be used to improve fracture repair.

In order to reduce side effects of drugs, such as for example bisphosphonates and hormone replacement therapy used to treat bone loss it is possible to combine drugs with administration of selected lactic acid bacteria and thereby reduce the dose, which will minimize the side effects.

Example 1

Study of *L. reuteri* ATCC PTA 6475's Ability to Reestablish Altered Microbial Communities in ovx Mice.

There are significant changes in the intestinal microbial communities of control (non-ovx), ovx and ovx fed by *L. reuteri*.

Experimental Groups and Tissue Collection.

In order to measure the effects of ovariectomy (ovx) and *L. reuteri* 6475 treatment of ovx mice we compared three experimental groups of animals. Control mice were non-ovx mice that received a vehicle control gavage three times per week. Ovx mice received a vehicle control gavage three times per week. Ovx+*L. reuteri* 6475 were mice that received 300 µl of overnight *L. reuteri* 6475 three times per week for four weeks. At the end of the experiment mice were euthanized and tissue samples from the stomach, duodenum, jejunum, ileum, proximal and distal colons were isolated and saved for microbial ecology analysis.

DNA Extraction

Murine intestinal tissue was placed in MoBio Ultra Clean Fecal DNA Bead Tubes (cat.#12811-100-DBT) containing 360 µl Buffer ATL (Qiagen cat.#19076) and lysed on a Mini-Beadbeater-8 (BioSpec Products) for 1 minute at full speed. DNA was extracted from murine intestinal tissue using Qiagen DNeasy Blood and Tissue kit (cat.#69504). The tissue was further disrupted by adding 40 µl proteinase K (Qiagen, cat.#19133) and incubating at 55° C. for 1 hour. DNA was extracted using the Qiagen DNeasy Blood and Tissue kit (cat.#69504). DNA yield was quantified using a Nanodrop 1000.

PCR Amplification

Bacterial 16S sequences were amplified for 454 sequencing from murine intestinal tissue using the V3-V5 barcoded primer set and amplification protocol developed by the Broad Institute for the Human Microbiome Project. Barcoded forward primers were synthesized by IDT DNA Technologies and the reverse primer was synthesized by Sigma. Barcoded forward primers were diluted to a working concentration of 4 µM in 96 well plates; the reverse primer was added to each well to a final concentration of 4 µM. Triplicate reactions in a 25 µl volume were prepared containing 400 µg murine intestinal DNA, 2 µl 4 µM primers, and 0.15 µl Accuprime HiFi Taq polymerase in 1× Accuprime Buffer II (Invitrogen, cat.#12346086). Reactions were amplified in an Eppendorf Pro aluminum plate thermal cycler with a 2 minute 95° C. denaturation, followed by 30 cycles of 95° C.×20 sec, 50° C.×30 sec, 72° C.×5 min.

Amplification Product Purification 16S amplification products were purified using Ampure Agencourt XP beads (Beckman Coulter, cat# A63880). First, triplicate reactions for each sample were combined into 1.7 ml microfuge tubes and Ampure XP beads were added at a 0.7× volume ratio. After vortexing, the mixed samples were incubated for 10 minutes at room temperature then placed on a magnetic stand to separate the beads (Invitrogen, cat.#123-21D). The beads were washed according to the manufacturer's protocol with 2 washes of 200 µl of 70% ethanol. The beads were dried at 37° C. for 5 minutes, and DNA was eluted with 20 µl 10 µM Tris buffer/0.1 µM EDTA. The eluent was separated from the beads on the magnetic stand, transferred to a new 1.7 ml microfuge tube, and quantified using the using the Quant-It dsDNA high-sensitivity assay kit (Invitrogen, cat# Q33120). Equal amounts of each sample were then pooled into one tube for 454 sequencing.

454 Sequencing and Sequence Analysis 454 sequencing was performed using the GS Junior (Roche) using Titanium chemistry. In addition to the standard filters utilized by the GS Jr. to identify passed reads we utilized a modified amplicon processing algorithm to reduce the number of incorrectly discarded sequences. 16S rRNA sequences were aligned by the Ribosomal Database Project staff at MSU to *E. coli* 16S sequences and trimmed at *E. coli* 16S nucleotide positions 617 to 900. Subsequent processing and analysis (including diversity metrics) were performed using MOTHUR v.1.21 (http://www.mothur.org/wiki/). ANOSIM (analysis of similarity) and principle coordinate analysis were performed using the software package PAST. The accompanying figures and table utilize the Bray-Curtis method for measuring the level of dissimilarity between two or more microbial communities. In these analyses we chose an operational taxonomic unit (OUT) cutoff of 0.03, which is considered to be viewing the communities at the species level. From these data we conclude that in that treatment of ovariectomized mice with *L. reuteri* ATCC PTA 6475 causes a significant shift in the both the ileal and jejunal microbial communities, which correlates with improved bone health. (ovx+lacto in the table 1).

TABLE 1

ANOSIM analysis at species level using Bray-Curtis dissimilarity matrix, ** indicates statistical significance.

| Tissue | Comparison | R Value (p value) |
| --- | --- | --- |
| Jejunum | wt-ovx-ovxlacto | 0.3367 (0.0183)* |
| | wt-ovx | 0.0443 (0.3633) |
| | wt-ovxlacto | 0.6078 (0.0250)* |
| | ovx-ovxlacto | 0.3297 (0.0712) |
| Ileum | wt-ovx-ovxlacto | 0.2068 (0.0084)* |
| | wt-ovx | 0.1710 (0.1180) |
| | wt-ovxlacto | 0.2540 (0.0290)* |
| | ovx-ovxlacto | 0.2209 (0.0206)* |

Three-way comparison of the wild-type, ovx, and ovx treated with *L. reuteri* showed significant shifts in microbial communities (table 1). These differences are largely driven by substantial shifts in communities after *L. reuteri* treatment. Principle coordinate analysis of microbial communities from the wild-type control group (triangle Δ), ovx group (circle ●) and the ovx group treated with *L. reuteri* (square ■) was used to visualize how communities clustered in the jejunum and the ileum. FIG. 1 shows that ovx mice treated with *L. reuteri* form a cluster of communities that is distinct from wild-type and ovx communities in both the jejunum and ileum. Several OTUs that were classified as Clostridriales are the main groups of bacteria that are driving the separation of the L. reuteri treated Ovx communities from the other two groups.

Example 2

Study of L. reuteri ATCC PTA 4659's Ability to Reestablish Altered Microbial Communities in ovx Mice.

The experiment is performed as in example 1, but L. reuteri ATCC PTA 4659 is used instead of L. reuteri ATCC PTA 6475.

L. reuteri ATCC PTA 4659 treatment is not able to restore ovx communities toward control.

Example 3

Identification of Certain SNPs
Illumina Sequencing of L. reuteri Genomes

L. reuteri strains used in this study were ATCC PTA 4659 and 6475 grown in MRS media (Difco) and genomic DNA prepared by using the Qiagen Genomic-Tip System. DNA was fragmented by 20 min sonication (130 W) to obtain an average fragment size of 500 bp, then further purified and concentrated with QIAquick PCR Purification Spin Columns (Qiagen). Treatment to remove 3' over-hangs and fill in 5' overhangs resulted in blunt-ended genomic fragments. An adenine residue was added by terminal transferase to the 3' end, and the resulting fragments were ligated to Solexa adapters. The products were separated by agarose gel electrophoresis, and the band between 150 and 200 bp was excised from the gel. The DNA fragments were extracted from the agarose slice using a QIAquick Gel Extraction Kit (Qiagen). Adapter-modified DNA fragments were enriched by an 18-cycle PCR using Solexa universal adapter primers. The DNA fragment library was quantitated, and then diluted to a 10-nM working stock for cluster generation. Adapter-ligated fragments (2 nM) were denatured in 0.1 M NaOH for 5 min, then further diluted to a final 9 pM concentration in 1 mL of prechilled hybridization buffer, and introduced onto the Solexa flow cell using the Cluster Station. Following isothermal amplification, clusters were made single-stranded by 0.1 M NaOH denaturation, metered across the flow cell by the Solexa Cluster Station. A sequencing primer complementary to one Solexa adapter was added to prime the single strands of each cluster. Once hybridized and with excess primer removed by a wash, the flow cell was ready for sequencing. The Solexa Genome Analyzer II was programmed to provide up to 36 sequential flows of fluorescently labeled, 3'-OH blocked nucleotides and polymerase to the surface of the flow cell, thus producing a fixed 36-bp read length. After each base incorporation step, the flow cell surface was washed to remove reactants and then imaged by microscope objective. The experiments collected 300 tiled images ("tiles") per flow cell lane, each containing on average 30,000 clusters.

SNP Analysis

The two lanes' sequencing results were mapped onto the reference genome L. reuteri JCM 1112T (GenBank accession no AP007281) separately. The mapping software Maq version 0.6.6 (http://maq.sourceforge.net/maq-man.shtml) was used to perform the mapping (default parameters). SNPs were identified and validated by the MAQ software, and classified into coding SNP and intergenetic SNPs. Coding SNPs were identified as synonymous and nonsynonymous. The SNPs were finally verified by PCR amplification of the surrounding region, followed by Sanger sequence determination.

Example 4

Method of Selection of Strains

The selection of strains effective for prevention of bone loss is based on the ability to restore altered microbial communities. Based on the results of examples 1 and 2, L. reuteri ATCC PTA 6475 is selected based on the fact that this strain has the ability to restore altered microbial communities. L. reuteri ATCC PTA 4659 is not selected based on the results of example 2.

Example 5

Method of Selection of Strains

The selection of strains effective for prevention of bone loss is based on the presence of certain SNPs. As a consequence of the results of example 3, L. reuteri ATCC PTA 6475 is selected, since it harbors all of the four sought SNPs. Due to the lack of these SNPs L. reuteri ATCC PTA 4659 is not selected.

Example 6

Method of Selection of Strains

The selection of strains effective for prevention of bone loss is based on example 3 and 4 and 5, strains harboring at least one of the four sought SNPS as well as the capacity to restore altered microbial communities is selected. Based on these criteria L. reuteri ATCC PTA 6475 is selected.

Example 7

L. reuteri ATCC PTA 6475 Suppresses Ovx Induced Bone Loss

In this study ovariectomized (ovx) BALB/c mice were used as a mouse model for bone loss. Mice (12 weeks old) were ovariectomized and divided into two groups were the first group was treated with L. reuteri ATCC PTA 6475 three times a week during four weeks. BALB/c that had not been ovariectomized were used as a control group. Distal femur bone volume fraction (BV/TV) and bone TRAP5 RNA (relative to HPRT) were measured. Mice treated with L. reuteri ATCC PTA 6475 showed the same bone volume fraction as the control group. Further it was to be seen that TRAP5 (a marker of osteoclast function) is returned to baseline (control group) upon L. reuteri ATCC PTA 6475 treatment.

Figure 2:
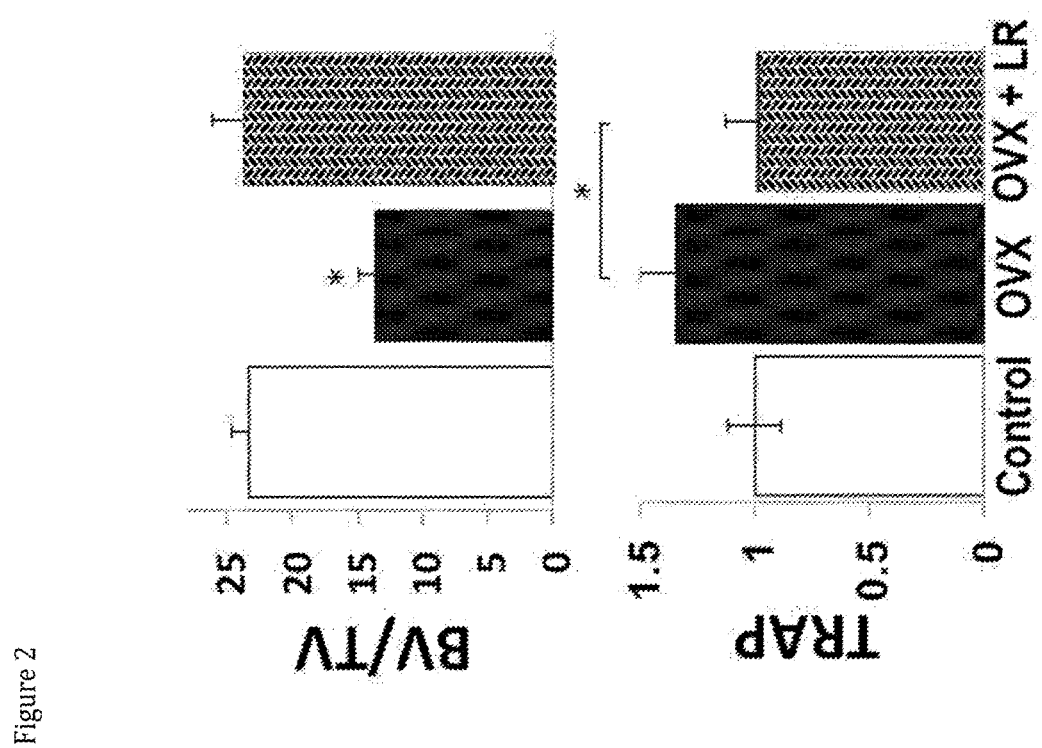
FIG. 2 shows the suppression of bone loss by L. reuteri ATCC PTA 6475.

FIG. 2 shows that the suppression of bone loss by L. reuteri ATCC PTA 6475 is nearly 100% and that the expression of TRAP5 is returned to baseline.

Example 8

The Selected L. reuteri ATCC PTA 6475 is Superior to the Non-Selected L. reuteri ATCC PTA 4659 in Suppressing Bone Loss.

Figure 3:
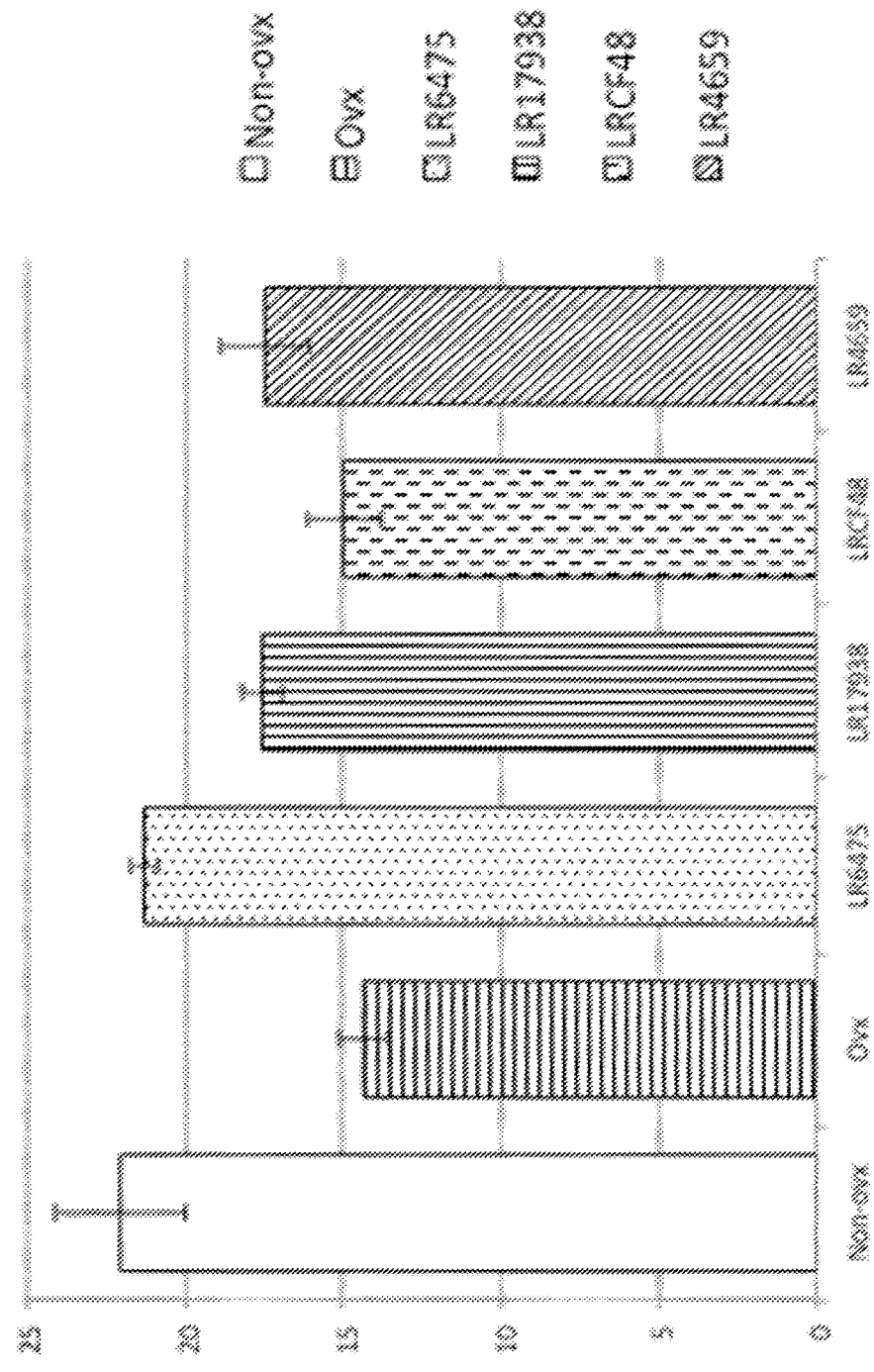
FIG. 3 shows the effect on bone loss in different L. reuteri strains.

In this experiment we gavaged animals three times per week with the L. reuteri ATCC PTA 6475 and L. reuteri ATCC PTA 4659 strains while also providing the strains continuously in the drinking water for 28 days. Distal femur bone volume fraction (BV/TV) was measured by μCT. L. reuteri ATCC PTA 6475 suppressed bone loss and was indistinguishable from control mice (FIG. 3). L. reuteri ATCC PTA 4659 did not suppress bone loss to a sufficient level that reached statistical significance (p<0.01). L. reuteri ATCC PTA 4659 is not as effective as the selected strain L. reuteri ATCC PTA 6475.

SEQUENCE LISTING (1 sequence)

SEQ ID NO: 1 - DNA, 2039414 bp, Lactobacillus reuteri
ttgactgagctcgattctctgtgggaagcgatccaaaattcatttcgtcaggataccactccggttacctttgacactttgattgctccggcaaaagcaatttctctctctcaaaatcaactggaaatcgaggtgcccactccggtgcaccgcgatttttggcgcaaaaatttaaatacgcagcttaaagaattcgctcaacgggaattgggacgaaatattgagccgcattatgttttagagggagaatttacctatacaaataaaaaaacagaagatgatccaactccttcttttgagatggatactcctctaaatcctcattacaattttggaacattcgttgttggcgagggaaacaagatggcacacgctgcagcatttgccgttgccgaaagccccggcagcctttacaacccactatttatttatgggggggttggtttaggaaagacccacttaatggaagcgatcggtaaccatatgcttcaagttaatccaaattcgcgtgtcaaatatgtgacgagtgaggattttaccaatgattatatcaatgctattcgtaataacacgactgaacaactaagagaagaataccgtaacctcgatctcctattaattgatgatattcaatttttagctaacaaagaggggacgcaactagaatttttcaatacttttaatgcccttcatgatcgcaaaaaacaaatcgttatgacctctgatcgaattccaaatgagattcctgaactgcaagatcggcttgtatcacgtttcaggtggggacttactgtcgaaattactccgcctgacttagaaacgcgaattgcaattttacggagcaaagttgaggaagatcatattgatattggaaacgacacccttaactatattgccgggcaaattgatacaaacattcgtgagctagaaggagccttaacaaaggttcaagcatttgctaatttaagcggtgagcgaattacgccaagcttagcatcccaagcattaaaagggcttcaccgcgtagccaaaaacgaaatatcaatcgctacaattcaaaaacaagttgctgatttttataatataactcaaggagatatccttggtaaaaagcgagttaaacaaattgttatgcctcgccaaatagctatgtatctttctcgagaactcaccgattcctctttgccaaaaatcggcaacgaattcggcggcaaagaccataccaccgttttacatgctatcgataaaatcgagacagaactaaaaaaggatactgacttacaaaacgatattacaaaattaaaagctaaactacgatcataacttgtggataagtataataattatcctcaaacttatccacaagttatcaacaggtggataactcgcaataacaggtgtttaaatagttttccacagtattaacaggctctactactacgactatattttaaactattaaatatatttatatacttacacaaaaggactgaaacatatgaattttacaattaaccgatctgcattcattagtcaattaaataatgtcttacgtgctatttcatctaaaaccacgattccaattcttactggattaaaaatggtagtaaacgaagacaatattgtgttaactggtagtaattctgacatcaccatcgaaagtgttattaatgctaatgacgctgataacgatttaacaattgaagaaactggcgctattgtattaccagcccgcttcttcagtgacattgttaaaaagctaccagataagaaagtaactattgaagttacaagtggttttcaagcagatattacatctggttcagctaaattccaaattaatggtcaagatgctgaaaactttccccatttaccagaaattgaaactaataaatcagtaactcttcctaacgacatccttaaagaagtgattcgtcaaaccgttattgcggtatctaagcaagaaagtcgcccaatccttgccggggtgcatatgatgttaaaagatggcgttctaacagctgttgcaacagatagtcatcgacttgcacaacggaaagtggtcctcgaaaatattgataacggcatagattttgatgtgattattcccggaaagagcatggaagagctttctggaatgattagcgatgtccatgaagatgtacaaatgcaagtaaccgaaaatcaagtattgtttatctttggtaatactcatttctattctcgattactagaaggaaattaccctgaaactagtcagttaattccacaaactgctgatacaacagttgaactagaagctgggacatttttatcatcaattgagcgtgcttcgcttttatctcatgaaagccgtaacgatgtggttaagttaagtctaaagccatcagaaaatcttgtccgaattagtggtgattctccagatatcggtacggttgaagaagaggtagtaacgtctgctcttgatggtaatgatcttgaaatctcatttaatcctaactacatgaaagatgctttacgttcttttggtcaggcaacgatcaagatttcatttacttcaccattgcgaccatttaccttggtgccaacagaagatcaagaaaattttgtccacttaattacgccagtacggacattttagaaaggatcttaataagttttataaaaagaggctacagaatgttttgttttgtaacctcttttctatttggcatagattaaatttaataagtattgctagtttatattcagatttttgaccatagagcaaatttaaccgaattttgataaaaaaggctaaattaagttaatgcgctcagaaaggctaataacgcaaaattaggccgaataatgtggtataatagaattacaaaagtaggtgaaaaaaatggaagaaaagtcagtgttgattgatagtccatttattacgctcggtcagttactcaaagaagaggggattattcctactggcggagcagctaaatggtttctaaaagaaaatactgtattagtaaatgatgagccagatgatcggcggggacgcaaattgtatcccgaagataagattcaaattcctgaccaccaattacttgttattaagagtaagtagggataagcatgattctgacggaattgcatttacatcactttcgaaattatcaggatctaaccgttcacttcaaccctggagtgaacgttttaattggtcataatgcacagggtaaaacgaatatgctagaggcaatctatgttctttccctgaccaagagtcatcgaacaagtaatgaccatgaacttattaattggcaagaaaaatcagctctaataagtggcacggtagaaaaaagtattggcaagattccacttgaattacaattctcaagtaaaggaaaaaaggcaaaggtaaatcatttagaacaggcgcgattatcacagtatgttggtcaactaaatgcaatattatttgcccctgaggacttgtcgttggtaaaagggtccccagctttacgccgccactttatggatcgagagtttagccagatgagtagcaaatacctctacaatgcaggccaatatcgcacactcttacgacaaaaaaacaaatatttaaagcaactaaaatataggcaacaaactgatcgcgtccttttaggagtcctatctgatcagcttgctgcttttggtgcggaagtaattattgcccgtcaacattttttaaagcaccttgaaggatgggcagctgatttgcatcaagaaatttcactaaataaggaatcattacggcttgagtacgttaatcaattaaaggttagtgatgatactactgttgaagaggcttatcaggcactatttaagttatatcaggataatgaacagcgtgaaatcgagcagggaacaacaatttatggtcctcatcgggatgatatccgttttctggtaaatgataaaaatgtgcaggcttttggatcgcaaggacaacagcgaacaacagcactatcagtaaaactagcagagattgatttgatgaaagagcaaacaggcgagtatccattattattattagacgatgtgttatcggaactagatacgattcgacaaacacacctgttaacagccattcagaataaagttcaaacatttttgacgaccactagtctgagtgatgttgctcgccagttaattaatgaacccacgatttttgaaattgagcacggcactttgaataaggaggaagtaaagtgagcaacgaacaacaaaaagaaaccaagatggaattggctagcgagtatgatgctagtcaaattcaggttttaaagggattggatgcagttcgaaagcgtcccggaatgtacattggttccacttcagcccagggacttcatcaccttgtttgggaaattgtcgataacggaattgacgaagccttagcaggattctgtgatgaaattaatgttgtagttaatccagataacagtattactgttaaggataatggtcggggaattccagttgatacacaaaaagaaaccggaaagtcagccttagaaacggtctttactgttctgcacgccggaggaaaatttggtggcggcggatataaggtttctggaggtcttcacggggtaggagcttctgttgtaaatgccttatccactgaattggatgttaaagttgctcgtcaaggtaaacgttactacatggattttgatcatggtcatgttaagtctgcaatgaaggtaattgaagagggacttccagaaactgagcatggtacaaccgttcactttaagccggatccagaaattttccgtgaaacgacaacttataatattaaaactttaactgatcgtttaagagaattagccttcttaaataagggacttaaaattacgatcgaagacttacgacaagcagaccatgaacggaaagaattccattatgaaggtgggattcgtcattatgttgaataccttaatgaagatcaaaatgttttatttgacccaccgatttacgtggaaggtaaagaaaacgatattactgttgaagtttccttacaatatacagattcataccgcagtaacttgctaactttcactaacaatattcatacttacgaaggtgggacccatgagaccggatttaagatggcccttacacgtgttatcaatgattacggccacaaagcaggtatcttaaagtcaaatgagaccttatcaggggatgacgtacgggaaggtttaactgcggttgtctccattaagcaccctgatccgcaattcgagggacagactaagactaagttaggaaactcagatgcacgaacagcgactgaccatgtctttgcggcaacatttaaccggttcttattagaacacccagacgaagcgcggcaaattattgaaaaaggtcaactcgcttccaaagcccgggtggctgctaaacgtgcccgggaagttacccgtaaaaagagtggtcttgaaattagtaatttaccaggtaaattagcagataacacaagtaaggatccggaaatttcagaattatttattgtcgagggtgattctgccggtggttcagcaaagcaaggacgttcgcggctcacccaggcaattcttccaattcgcggaaagatcttgaatgttgaaaaagcaactcttgatcgagttctagctaatgacgaaattcgttctttatttaccgctcttggaacaggatttggtgatgactttgatattacaaaggctaattaccataaattaattatcatgactgatgcggatgtcgatggtgctcatattcggacattactgttaaccttgttctaccgctttatgaaaccaatgattacgcatgggtatgtttatattgctcagccgccgctatatcaagttcggcaaggtaaatttgtaaaatacattgactctgatgaagaactagaacaggttgtaagctcactacaaccaagtcctaagccagttattcagcgttacaaagggttaggtgaaatggatgctgagcaattatgggaaacaacaatggatccagagaatcggcacctattacgagtaaaactagacgacgcagaacaggctgataagattttcccaatgctaatgggaaccaaggtcggaccacggcgcgactttattgaacaaaatgctaagttcgttgagaatcttgacctgtaattaactgttgtttactgctaacgcaaaaaaggaggaacgacattggctgaacaagatatgcctaatcgaatcacggatgtaaatcttacgagtcagatgaaaaactcattcttggattatgcaatgagtgttattgtttcacgtgcgcttccagacgtccgtgatgggttaaaaccggtacaacgccggattctatatggaatgaatgaattaggggttactcctgataagccttacaagaagtcagcccggattgtcggggatgtaatgggtaaattccaccctcatggtgactcttcaatttatgaaggacttgtgcgaatggctcaagactttagttatcgttacatgcttgttgatggtcacggtaacttcgggtcggttgatggtgatggagcggccgccatgcgttataccgaagcaaagatgagtaaaattgcggttgaaatgcttcgggatatcaataaagataccgttgatttccatgataactatgatggtactgaaaaagaaccggatgtattaccagctcgttttcctaacttattagttaacggtgcctcagggattgccgtggggatggctactaatattccaactcataatttaggtgaggttattaatggccttcatatgttaatgaatgaccctgatattacaactgaaggcctaatgaaggctattcctggccctgactttccaactggtggagtagtaatgggaaagtctggtattcgtaaagcatatgaaactggccgaggaactattattgttcgagcaaaagttgatattgaagaacaaaaaaatggtaagcaacggatcattgttcacgaaattccatacatggttaataaggcaaagttaattgaacgaattgctgaattagctcgaaataaagatatcgatggaattactgatgttaatgacgaaactgaccgtgacggaatgcgaatcgtaattgatgttcgtcgtgatgcgagtgcggaagttatcttgaataacctttacaagatgactttgatgcaaacaacttttaacttcaatatgctagcaattgttaatggtgctccaaagattttaagcttaaaacaaattttgcaatattatctggaacaccaagaatcagttgtacggcgacggacagaatttgaattaaagaaagcacaaaatcgtgcgcacattgttgccggattgcggatcgctttagaccatattgatgagataattaatattattcgtaattcacaaacaagtgaagtagcgaaaaatgagttgatgaataattatggtttatcagatcggcaggcacaagctattcttgatatgcggttagttcggttgactggcctagaacgggaaaagatagaggatgaataccaaaaattaatggcagcaattgccgattacaaggatattcttgctcatcgcgaacggattaatcaaatcatttatgacgaattgatggaaattcaaaaacgttttggggatgaacgccggactgaacttcaagttggtgatattaccaatattgaagatgaagacctaattgaagaagaagatattatcgttgccttgactcacaatggatacattaaacgtcttccagttgatgaatttaagtctcagcatcgtggcggtcgtggtgttaagggaatgggagttcataaagatgattttattgaacaactaatttctagctcaactcatgatatgttgctcttcttcactaattcaggaaaagtatactcaatgaaggggtatgaagttcctgaatatggtcgggctgctcaaggaattccaattattaatcttcttggaattaataataaagaaaagattagtgctgttatcaatgtttcacatgaaactaatgatgatgataaataccttttctttactaccaagctaggaactgttaaacgaacagcagtaacagaatttaagaatattcgaagcaatggattgaaggcgctcaacctccatgaaaacgatgaattgatcgatgtagaagttattagtgaagatcagccaatgattattggtactcataatggatatgctcttagctttaaatcatcagttgttcggtcaatgggacgaagcgcggctggagttcgtgggattcgcttacgggatgaagactacgtaattggcgctgcccctcttaattctgatagcaaggttcttgtaattagtgaaaatggttttggaaagcaaacttctgcttctgaatatccaatcaaaggacggggtggactaggagttaagacagttaatgttactgcaaagaatggtccgttggttggtttaacgaccgtcaatggtgatgaagatatcatgttagttactgaccagggagtaattattcgttttggtattgaaagtgtatcgcaaactggacgatctgctgttggtgttcacttaattaagatggataatggtgcccgtgttgctacgattgcaaaggtggataaagaagtcgatgaggagactgaagaagctactaacaattcctcacaagaagaaagtcaaccaacagaaaattaaaaaaataaagtgagaaagtagatattttacgtatatatagttatagtgaccgcaacatttaggatttcttgttagatgttccttgttttaaatagaattttatgctatattttatgtctgtgagtatacgtaatgacgtctactttccttgttcttctcaaatagcgagaagagccagagtccataaggaggtgtaacattcatggaaacacgcaaatatgaaattacttacatcattcgtcctgatatcgaagaatctgcaaagagcgaattggtagaccgattcgacaagatcttggcggacaatggtgcaactatcgctgattcaaaggattggtcaactcgtcgttttgcttacccaatcgctaagtacactgaaggtacttaccacgtggtaaacttaactactgattccgatcaagctttaaacgaatttgatcgtttagctaagttcagtgatgatatcctacgtcacatgattgttaagcttgatgcttaattaatttgtcagtaaagtaaagagaggagaaagatctatgcttaatcgtgcagtcttaactgggcgtttaacaagagatcccgagttgcggtacacaaccagcgggacagcagttgtttcatttacgttagctgttgatcggcaattccgaaaccaaaatggtgatcgtgatgctgattttatcaattgcgttatttggcgtaaatccgctgaaaactttagtaactttacgcataagggttcacttgttggaattgaagggcgtattcaaacccggaattatgaaaaccaacagggtaaccgtgtgtatgttaccgaagttgttgtagataattttgcattgttagaacctcgtcaaaatggtggcatgaaccaatcaggggttcaacaaccatttaacagcaaccaacaatcatttggtgctcaggctccacaatatggtagtcaaccacaacctggaaataatgctcctcaaagtaatccgtcaccaagtatggataatggtttcgatcccaatcaaaatgctggcaaccagttccctggaagcagtgatgatggtggtcaatccattgatttagctgatgacgaattaccattctaaataaatttttactcagaataggagggtaatttcatggcacaacaacgtcggggcggacgtcgtcgtcgtaaggtcgacttcatcgccgcaaaccacatcgaatacatcgattacaaagacactgatttattacgtcggttcatttctgaacgtggtaagatcttaccacgtcgggttactggtactagtgctaagaaccaacgtaagttaactatcgctatcaagcgtgcacggatcatgggtcttttgccattcgttgcagaagactagtttccgcaagaataaaaaataataaagaggccgaggtttactcagcctctttattattttaaattactgttatcttttctagaatttttcgactgctatattaatattcttatgtattaataatcattagatgatataatctattgactaagtacttgatgtgatatgatagatttatccaattaataatttaaagctatttttaggaggactagcatgcgaaaaattttcagtcgtgagaactgggagttttattttgaacacccagccgtccgctggaatgtctgctatatagtgcttttaacaatcattgggcttattttagggtttatggataactggattattggactaattgttttagtaatcgcagttattggtggagctattagtattcggcggttaagaaaattagtagtcgatgctcatgaatatttaaatgaattaacgtataaagtccaacgtgggcaacaagaagcattgctggaaatgcccatgggaatgattatgttaaataagcgtcatgaggttgaatggattaatccatatatggcgcgttattttaatcttgaaattgttgtagggaagccgattgcagatgttgatgcaaaattagcggaattaataaaagatcatgcagatgataagcaaacacaagtagtgacttggcgtgaccatcaatttgaatttttagttcagcatcacggacaggtagtttatttattagatattacaaaatatgaacagattagtgcacaatataaggatgaacaaatcttcattgggaatatttacctagataattatgatgagctgattcaagggatgagtgattctgatgtctctaatcttcataattacgtaacttcacaaataagcgattgggcagttgctaatcacttattgatgaagatcattgatgatgataactacttgattattggacatcaagcttcattaaaagaacttgaaaaacaaaaattcaagatccttgatgttatccgtgaaaatacatccaagcaaaattcgccagttactcttagcgtaggaattgcttatggcgaaaataatttgataaaacttgctgatacagcacaaaataaccttgacctcgcgttaggtcgtggtggagaccaagttgttgttcgtgctcaagatcaggaagcacgtttctatggtggaaagaccaacccgatggagaaacgaacccgggtacgagcacggatgattagtcaagcattacaagaattaatggcccaatcagaccaattatttgtgatgggccacaccaatccagatatggattcaatcggtgcttgtttagggattcgacggattgcggaaatgaacggtaaagaatgttggattgtgattgatgacgaacatccacactctgatattcaacgtttgatgcatgagatcgataattaccagacgattaaggaccatattatttcaccagtcgaagcgttagaaaaagcaacaaataacagtttattagtgatggttgaccatgctaagcggggaattaccattgctcctgaattatatgataaaatgcaaaacagacttgttatcattgaccaccaccgtcgcggcgaggactttcctgaaaatccattgcttgtttatattgaaccatatgcttcatcaacttgtgagttaattacggaaatgtttgagtaccaaccacgtgaaggaaaaggacttaacaagcttgaagcaacggcaatgctaacaggaattcaagttgatacaaaatcattcaccaagagtgctggtacgcgaacttttgacgcagctagttacttgcgttctgctggtgccgatggtttaatgattcaatcatttatgaaagaaaatccagaaacatttatgatgcgtaatcatttgatttcaagagcggaaataaatgataaaatagcattatgtacgggtgaagaaggacaggtttatgatcctgtcacggctgcccaggctgctgatatgttgctccaaatgagtggaattgaagcttcatttgtaatttttgaacgtgctgataacaagatcggaatttcagcacgctcaatgggaaacgtcaacgtccaagtaatcatggaaaaaatgggtggtggcggtcaccttgcaaatgctgctacacaaatcagtgataaagatattacgcaggtcaagcaagagttagtcgatattctaactaaacctgataaagagcaagacgatacagaggagtgatcagaatgaaagttatttttacacaagatgtacgaggccgtggtcaacgtggtcaaattaaggaagttccagatggctatgctcaaaactacttaattaagcgtggattagcaaaacaagctactaaggcggcgatgagccaactaaagggtcaacagcgtgctgaagaaaaacatgctgctgaagaattagctgatgccaagcggatgaagaagattcttgaagatgataatacagttgttgaattaagcggaaaagccggtacagatggccggatgtttggttcaatttcaacaaaacaaattgcaactgctttacaaaaacaatttgaccttaaaattgataagcgaaagattgagctggcagccccaattaaggcgcttggttacgttaatgtgccaatcaagcttcacccggaagtagaagctcaaattcgtgttcacattgctgaaaagtaatgagggttaatagatttaaggagcggtatcgttatggataatgcaccagtgcaagaagagccacgcgatattgaagcagaaaaagcagttcttggagctgcttttttaagtaaaaatgcgttggctgatgcgatggaatatcttgagccgcaagatttttaccggaaggctcatcaaatcatttttgaaaagatggtccaactaaatgatgcggaccagccaatcgatccgttaacgatgaaaaatgtccttgatcaggataatcaaacggaaaatgttggtggagttgcttatattgctgaacttgcaacagcggttccgacggctgctaatgttgtctattactcaaagattgttcatgataaggcaatttcacgacggttgatcaatacagcaaccaagattatcaatgatagctatgccggaaatgacaaaattgaagatcaacttgaccgggctgagcaagaaattatgtccgtttcggaaaatagtcgtcaaactggttttaaaagtattagtgacgttttacaagagtcgattaaccatgttagtgagctctctagtcaagattcagagattactggactttcaactgggtatgctcaattagatgagatgacgactggtcttcataaagacgagttggtaattatcgcggcacggcctgctgttgggaagactgcctttgttttgaatattgcccaaaacgttgcaactagaaccgataatacggtcgcaattttcagtcttgaaatgggtgcggagtccttagcaaaccggatgctctgtgctgaaggaaacattaacgctaaccacttacgaactggacagcttacgcaggatgaatggcaaagtttatttattgccactggtgccttaagtaatgcaagtatctatattgacgatacaccaggaatcaaggtagcagaaattcgggcacgttgtcggcgcttagcaaaggaaaaaggcaatttaggcttgatcgtaattgattaccttcagttgattgaagggagtaatcctgataaccgacaacaagaagtttcagaaatttctcgacaactaaagaaactggcaaaggaattagaagttccagttattgccctatcacagttgtcgcggggagttgaacagcgacaagacaagcgcccggttttatctgatattcgtgaatctggatcgattgaacaggatgcagatattgttagtttcctttatcgtgatgactattatgagcacgatgaagattcggaagataataataacccgggaaataatcaggatgacgatggatcaaacgctagtgaagttgaagtcatcatcgaaaagaatcgtagtggtccgcgggggacagttaaattattatttgcaaagtcttataataagttcacttcgatttcctatattcctgaagataataattaaaaactaaatttctaagagggcatttcagtaaaaactgaggtagcccttttagtgcgcttaagacattaaaaatgtttttaaaaaaataaacggtatgatagtaattgaggaggcgtaaacaatgaaccatcaaggcgtagaattaaaatggcttttattcggaatgttccttggaagtattgggaatagttttgtctggccattaacaacaatttatattcacgatcagttgcatgagtcattaactgtatcgggaatcgttttactcttttattcgggagcaaacgttgtcggaagttatattagcggaatgttatttgaccgagctaacccgcggaaattaatgattggcgggacactgctagcgacaatcgtaatgactattatgattttcttcaatggctggccgatatatggaattcttttaacagttattggattcttcaatggttggattatcacaatggttaattcttttgcgactcgttcagggcgagatggtcgttatgtctttaatatgttgtattttgccaataacttgggaatggtgattggaactactattgtcggtccgctttaccagtatgcagatggtaatgtttcaccgatgtttttgattaccacaattctctatacaatgttctcgcttgttgttatctttttctttaaggatagtcaacagacagttgcaaagaccgaagatgtggaagatgaagaagagaacaagacagttaatattaagatgcctcaagctaacttatggattaactggatcttcttcattgccttagttgtaatctggacaatgtatgaacaatgggcaagtaacttatcagttttcatgactgatcaaggaatctcaatgacgaaatatagtcttttgtggacattaaatgggattttaatcgttgttttccaactaggaattacttggcttaatcgttgggttaatcgaccatatgcgcaagtatttattgggatgtttacaattggtttctcatttgtcctcctactttacgcccactcatatagctggtttgtggcggcaatggtcgttctgacaatcggtgaagccactgctctgccaacaatgcctgctattgtaaacagcctttcaccggttgctgttaagggaaagtatcagggaattctgaatgcattttcttctttaggaaaggcaattggtccgctatttggtggattgatgattgaagcgacctcttatcatatcctctttattatttgtgcgatttcaatttttgtaatggaaataatagtagtctttgttattaagataaaacgtgcaaaagcagttgaatattaaagaagtgatcagatgttttacaataattttgataatgtccatggtgaagaccgttatggaatggtaggaaaaacaggagatccttttagagaagaatgtaaactaggaatttcttgttatcagtgccatgaacagccgttagtaattgcggaaagaaattggatggatacgaataatgatgactcgcaacggtatcaaattgtggtagtttgtgagcattgtggtgctgttgatgaattcattgttaataatggtcgcgagcatcaaattagtaaattaaaacgtagtaagtatcagccaacagaaaagaatattataaataatggaactgtgaactagaattgttcatggttcttttttaaatccgtttttattaaccaaaacttgagagatttgctatgatggtagttgaaatcaaattaaaagcaatgaggtgaatgttgatgaaaaccaagaaatatcgttacactggaaaagactttgatattaagacggcaccaactaaggtaaaagattctgctgatgatcttaagaagattaaaaagaagatccgaaaaaatgtaaagtcaatcaagaatgcgcaaaagatgatgtatgcgcggcgtcattatggtgttttagtagtatttcaagcaatggatgcggcaggaaaagatagtatgatttcgcatatctttgcgggcgtaaatccagttgggtttaaggtggctaattttaaacaaccaacaggccgcgaattacgtcatgattatctctggcgaatcaatcgtgaattgccaatgcgtggtgatattggtgttttcaatcgatcttattatgaggacgttcttgtttcacgcgttcatcctgctttaattttgcaatctaatattccagggattgagtctgttcatgatgttaataacaaattctttgatagtcgctatgaagacattcgccagtacgaaagttatctaacacggaacggttacttaattgtaaaattcttcctccacgtatcaaaggaagaacagaagaagcgtttcttagcacggattgatacgccagaaaagaattggaagttttctgcagctgatattcgcgaacgtcaatattgggacgattaccaaaaggcatatgaaaaggcgattaatgctaccgctacaaaggaaaatccatggtatgttattccggctgatgataagtggtactcgcgtttaattgtatctgatattttaacaaagaagattaatagtttgccattagcttatcctgaggtttcgccagaacaagaaatgagcttacgccaagcacgaaaagaactaatagcagaagataagtaaataaaaaggacgtttgaatgacgtcctttttatttacgtggtttgtatatgtattggtggaaaaaggaatatattgctaatataaaacaatagagtaacatattaaggtgcttattaatgagaccatagattacaattatgatcattaatgctgtccatatataccctaaaagagtatagtgactttgcttataccagtattttcccaagaaaaaacattctttatagtataaatattctagcagaatacaaaataaaataggaattaaaatatttgaccaataattagaaggactccaaaaataaaatcctataagcaaccaaaacaatccacgaatgatattaaatgcttgtgaggctttatcgcggtttaggaaactagttaggtctttattctctctaagtaatgaatcaacagagacatgatatatctcactgagagcaagaagtaattttaaatcagggtaacttttgttgttttcccatttggaaagggtttgtcgtgtgatgtgtaattcatctgcaacgttttgctgagttagtcctaactctttacatcgactaagaatttgttcgccaaatgacatattaatttgctccttatattttgatataagaatacgaaaatagtaggaaaaagtctagcaatggtttattgcaatgcctatataataaggggtatgctaaagtaactaaaaaacacattattaattagattattcattcaaaaaagtagtttttagcatttatatatgaatttctaatgataagatgaatgacccggcagcaatcgaaagtgaataaaagagtaatcgccgttatccaatgacaaagactaaggcagccattgaagaattagaagcacttggcgcaattgaaattgtttcgaaacgtcctaaacaacatgtaattacaattttataacaaaaaaagaccaccgattactcggtgatcttttttatatgatgggcagtcaggggatcgaaccctggacccacggattaagagtccgttgctctgccagctgagctaactgcccatgtctttgacaacataaataataatatcaacttccgatcattttcgcaagtgtttttctaaatttatttaagaaattttcaaatccatattttaattaggtgtctaactgttataattaacaataaaattaaaattgggagtaatttcatggcattaaaaaaagataaatttgagcaaatgaaccgtttattgcggaactatatgattaacatgaagcatttttatactgaacttgcccctgaattagatgtaactccacagcaagctcatacacttttttatatagaaaaacatgctgggcttattcaacgagaactaggtgaccatttccatttacggaatgctagtgttactagtatggtgaaaaatcttgaacgcgacgggtatattatccggaaggcggatcaagagtcagcacgaattaagcggatttttcttaccaaaaaaggtgaagaaaagactaatgaggttaaagaaatatttgatcaagcttatttgcagattattgcccgtctcgatgaaagagatattgatgcaatagttaaagggatgactaatattaataacaatctaaaaaagtaagttagactcttgacagttaggcatctatgtgtttaaatattcatcatcattaaaagttagatatttaactgttaggaggcttatgctttgaacagaaataaatttagttttcggagtttctttagtttaataaatcaattacatccgcggtatattaagctttttgtgggaatcttactaggttttatctccacgggtgctaacctatttgttcctcaactagcgcaaaagctaattaataattttaagagtattagtccaacgttggcgattttaacagttgtaatttttatagcaggattaattacgagtgcgttatcagagttattattaggaatttttggtgaaaatgttgtttctaaattacggaaacaattatggcaaaaactacttaaaatgcctgtaaaatattttgatgatgttaaaacaggtgaaatcagttcacgattagttaatgatacatcacaggtgaaggatttacttgcttcaacattaccaaatgcaatgacatcgcttttacaattcgttggtgcactggttattatgttagcaatggattggcggatgacattgttgatgtttgtggcagttcctttagtgattttagtcatgctaccagtgatgaatcagtcgcgtaagattggtcgggttcggcaagatgaattagcaaaatttgctagtgattccaccgatgtattaggtgaggtccgattagttaagtcttcaaacggtgaagaacatgaactggcaaagggaaatcgccgcatcgacaatttatatcatgtcggaagaaaagaagcgttgattaactcagtaacgcaaccaattacaaacatgctcatgatgataatgtttcttgggattcttggttacggagcaattcgtgttatgaatggtgcaatgacaatgggcgccttagtttcgtttttaatgtatcttttccagattattagtcccgttgttgtaattagtcagctctttaataatatggcaaagactagcggagccacggaacgtatccaacaaatcttaactgaaccagaagaatttgctgctgataaagcagaaaaagatattgcgagcgcaccattgaaatttgagaatgttgattttgcatatgaggaaggcaagccagtcttacgagatgttagttttgaaaccaaacccaatgcagtggtagcttttgccggcccatctggtggaggaaagtcaactattttctcattgattgaacgattctatcagccaacaggtggaaaaattttgatcggtgaagagaatatcgaaaatgtagacttagccaagtggcgtgaacaaattggtctcgtaagtcaagatgccgcggtaatgccaggaactattcgtgataatttaacttatgggttacgaagagaagtctcggatgaggaactttgggacgcgttaagaatggcttatgcagatggttttgtcagtgaaatggaagatcagttagaaactgaaattggtgaacgagggatcaaactttctggaggacaacggcaacgaatagcgattgcgcgggcttttctccgcgatccaaaaatcttaatgcttgatgaagccactgctagcttggatgctgaatcggaggcgatggttcaaaaagcattgggagacttaatgcaaggaagaacgacactagtaattgcgcatcgcttgagtacgattgtcgatgccgataaaatctactttatcgaaaatggaacagtatccggtgcaggaacccatcaagaattattaaagacaacaccactatatgcacagtatgttaaggatcagtttaaataaaaataaagactgcgaaaggacaagattttcgcagtctttattttaagtatgaaaaaagcgactgagatcaaatctcaatcgctgtaaacctctgatgggcagtcaggggatcgaaccctggacccacggattaagagtccgttgctctgccagctgagctaactgcccatatcctttaacagaatacttaaacagtttaacctgttattgatcaaatgtcaaatatttttcataagtttttggaaaatatttatggaacttttccctgtgctataatagagacactgatatatagcagatttaaagtaattaatcaattaacccaatggagggaatcattgatatggcaaagaaaattttagttgttgatgatgaaaaaccaatttctgatatcatcaaatttaatcttgaaaaagaaggatatgaagttgtcgtagcctatgatggcgaagcagctttagaacaagtagaagcagaaaatcctgatttaattattcttgacctaatgctgccgaagatcgatggacttgaagtggccaagcgggttcgagctaagcataccatgccgattattatggtaaccgctaaagattcggaactagataaagtgctagggcttgaacttggggccgatgattatgttactaagccattctccaaccgcgaactagtagcacgagtaaaggctaatttacggcgtcaagcaactctgaaggcaccagcagaggaagaaaataataccgatattcaaattggcgaccttacgattcatcctgaagcttacaccgtaactaagcgaggcgaaaatatcaatttaacgcatcgtgaatttgagcttctccattatctagctcaacatattggacaagttattaaccgtgaacaccttcttcagactgtatggggttatgactattttggggatgttcggacagttgatgtgaccgttcgtcggcttcgtgaaaagattgaagataacccaagtcacccccaatggttaattacccggcgtggtgttggctattacctagcaaatcctgatcagaattagaggctgaaccattgtgaacagcaagttaaaattttatcaatcgattcgttttaaaatcgctctcgtattcgtgttaattttgatgttaacacttgaatgtgttggggcggtttttgtgcgtcaattagagcatcaaaaccttaatacgtttaagcaaaccattgaattaccgtcttacgttgataattctttagcagagcagttatcacgatcaaatactaaaaaagctaacaaacaaattaatcaaattctttcagaagttaataataataacatttctgaaatccgggtagttgatagtaagagtattgtgcggggaacaagcaacgctgataatcggagtgcaatcggtcagaaaacaacggaccaagcaatcaaagcaaccttattaaataataggtcgcataccgaaaacctgtacgataattcaaatcacacgcgttactatgtcaatgtgattcccctcgtggataacagtaataataacgttgtgggagctgtttacctgcgagctagtctggaaagtgtctactctaatattaataatattacgttggtatacttatccgcggcaatgattactattgtcttgagtttaatcttggcaattattatttcccaggaaattacccgcccaattgaagaaatgaggaaacaaacattacgaattgcccggggagactattctggtcaagtaaaagtattgggaaatgacgagttaggacaattggcaggagcagttaataatctttctgtccgggttgaagaggcacaggagtcgagcgattctgagcgacggcggcttgatagtattttatcccatatgtcagatggggttttagccactgatcgtcgcggaaatgtgacaattgtaaataatatggcgttacagttactgggtgtcgaaaatgaagacgatttaattggtaaatcaattattgatgtgttagatattcgtcatgactataccgttcggcaactagtaaatggtgaacagcgcgagatgattattgatatgtcaaactctggcaataatttgatcttaaacgcttacttctcaccaattcaacgtgaatctggctttgtcagtgggcttgtgtgtgtccttcatgatgtaacgagccagcaaaaagaagaacgcgaacggaagcaattcgtttcaaacgtctcgcatgagttgcggactccattaacaagtgttagaagttatgtcgaagcattaagtgatggtgcttggcaggataaagaaattgcccctcagttcttaaaggttgtccaggatgagacggaccggatgattcgaatgatcaatgacctgttgagtctatcacggatggatgcagggacaacgaagctcaatctggaatacgtaaatatcaatgagttatttaactatatcttggatcgtttcgatatgattattaaaaaagaagaagatccaaaaaagaaaaaatataccattgaacgatactttactaagaaagatttatgggttgaaattgatactgataagtttacccaggtaattgataatattatgaataacgcgattaagtattctccagatggtggtgtaattacaacacgattactggagacacataatcatgttattttaagtatttctgaccaaggcctagggattccacgaaaagatcttggacgtatctttgatcgattcttccgcgttgataaggcaagaagccggaagcaaggaggaacaggtctgggactagctatttccaaggaagttatcaatatgcttggtggacaaatttgggttgatagtgtagaaggcaagggttcaacattctatatttccttgccatatgtaccttatgaggaggaagactgggatgatgaagaagctgaaaagtaattggcaagcaatcgccttaacggttgttgtgcttcttagtttattcatttcatggattgtctggaccaacccatttccttttgagggagcacgacacgaaaatttcaataataaccaatcacaacaatatacaccgcaatcaatgggcgatgtttatctcccaactaaagcagttgagacaaatgaaaaaggaactcagaatcaactttatagccctaaagctaatttaattctgagcgtaaaaaaagagttagaggattggaaattaggccggacaaatgttgtcaaacaaaataacagtgatgtttatttgagttatttgcgacggcggaactcgttaatgctgacatatccggatgaggtaccgagctcagtcttcaacgaaacattttcccagtcaattgatactgaccgggttaatcagattaaccatattgttatcccattaaacgggcaacatgagatttacttacttggtgaccaccattatagtgtgtatcgagtacgggtagagaaaggaaaatttaatcgcattcggcaacttttaaagtcaatggatcggatcccggttgaccataaaattattaacgggatagcggtaatgatgtatccgcgaccctttgaattaccagcattaggatatcaaatcactgcgcaaaacattgatacccttagtgctagtctgatgagtactaaccaacacacaacaatcacggcaaatcggaatggtaacgagactacctatacggatggaaccaatcgtcggctgatatttaatcgccaaaatggaacgcttaaatacgaaaattaccttagtaaggacgatcgggaatcaacaagccagattttcccacacttctataataagttgacgacaattggaattccgcttgataatttgcgctatgatgaggtgagtgagcatggtcgtcggttaaactatcgggcttatgttaatagctttccaattttcaatagtgatggttatggggaagtaacgcttgaatccacaagtggcgggaatgaacgcttctggctaagtctttatagtcttcaagtgccattgccaattgatcaccagatggtcaagcttccatcaagtgcagatgtgattaatcaattacatgcaaccaaccggatgcgtgacatcaaggacttacgtgtcgggtatatttggaaaactgataaagatagtcatgttgtaaagttagtgccaacatatttcattaagtatcgcggccactgggttgaatataccgagttagaaaagtaggagggttaaagaatgaattttaaacgtattcaatggatctttatccttgcctttttgctttttgatatttttgttggaagttcattaatcttagaaactagatttaccgtttctaatggtcagcaaaatcgccaatcaacagtgttaaaagaaatgcgtaatgactcgattagttatggcgagctttctaataagcagcaaaccggatattatattgctggaaagaaatcttctgatggcggagacctagagcaggaaaccggaaaattacgtaatcaaaactttcgcctttcttcaggaacattgactagtgagtttgataagccaattaaaatcactgaaagtaataatattcggcgtgtcgaccgtctattaaaaaataaaaagatggtaagcttaggaaatcattatcgctataacaaggaattatcggacaaaaatacccttgtttatacgcaaatgctagaaggaaagccgctattttcaaatgatgggcaaattcgttttcggctaaactctgaccatgagataacaggttatacgcagacttacttgcaagatgttgaaattctccggcaacggtcaaatacgattagccagcgccgagcaattacctggttgtataaacataatcagattcctaataactcccgcattaggtggtcggtgctcagttattctaagctccttaacactactactgatgataaagcagtctatgtgccaacgtggactgttgaaatcaaaactaaaaactcaggagcaattcaacaattacaagttaacgcatttaatagtacagttatgaaggaaacgccagatagtgtgaatacgaactcgttaaataataagtaattgaggaggaactttaagtgacagaaacggatccattacgttatagtgtacttgcgagcgggagtactgggaatgtaacttatttggaaacgcgcaaccaccggatcttaattgatgccggtttaagtgggaagcggattgaaaatttaatgaagaagattgatcgatcattaaaggatgtcgatgcaatttttgtaacgcatgaacacagtgatcatacgcatggtgttggtgtattggcacgccgttatggaatggatgtatatgccaatgagggtacctggcaggcaatggctgataaagttggtaaaatcccattagcacaaaagcatattattgcaccaaatactgttaaggacttgggagacatggatattgaaagttttgcggtatcccatgatgctgcgcaaccgcaattttaccaagttcaccacaataataagaccttctgtattattacggatactggttatgtttctgatcgagttacgggaaccatccgaaatgcagatgcctacgtaatggaatgcaatcatgatacagaaatgttgcggatgggtccttattcatggccattaaaacagcgaatattaggggatgagggtcacctttccaatgaagaaggtgctgatgcattgatgagtgttgttggccggcgaaccaaagagatttttcttggccaccgtagtcaacataacaacatgcgttcgctcgcccacttaacagttgcaagtttgatggagcagcatgactttggcgttgaccatgattttaaattgcaagatgctgaaccagaagaaccaagcaagttaatgacgttataataaaagagatcacggtttttatcgactttattcaatgatttttcatatttaaattgtaacttgaagatagtgattctttaacttagtggagggtttaattgatgaataggataaaacaagcttttaaagatcggttgtggttaggcgtaattattgtcggcttatttgctggtcttattggtggtggaatcgccttaggaattaataacctggtacaacatcatgaagaagtaacaagtacacgagtcccagctggctctaataagtctggtggtacgaaggttaataagaataaggcggacttaaacggggaagcgtcccaagcttataagtccgtccaaggagccgttgttagtgttattaataaacaaaaggttcagcaatcaagtgggacgctaggaatttttggttatggcaacagtagtaacagcagcagtgattcttctagcgataataaattagaaaccgctagtgaagggtcaggagttatttataagaagagtggcaattcggcttatgttgtaactaataaccacgttgtcaaaggttcaaacgcgctccaagtaattttaagcaatggtaaaaaagttaatgctgatttagttggtgctgattctgcaaccgacttagctgtattgaagattaacgctacaaatgttaagacagttgcatcttttggtaactctaattcgattgttcctggtcaggatgtgctagcaatcggttcaccaatgggaagtgaatatgctaatacagtaacgaaaggaattatttctgccaaagatcggacattaaaagccggtactgatggaactttgacatcggttatccaaacagatgccgctattaactctggtaattcaggtggtccattaattaatatggcaggtcaagttatcggaattaattcaatgaaacttgcttctgatacacaaggctcttcagttgaaggtattggttttgccattccaagtaatgaagttgtgacaattattaaccagttaattaagaatggtaaaataactcgtccatcactcggaattagtatggtggatcttagtaatgttacttctgatcaacagcaatcagtcttaaaactaccaacaagcgtaagcaaaggggtagtgattatagatgtgaatagtggttcagttgctgatactgctggattgaaaaaatatgatgtcattacaaaacttggtgacactcaagttacagatgcgggttcattaaaggcagccttatataaatacaaggttggacaaaacgctaaagtcacttattaccgtgatggtcaacggcacaccgcaactttgcatttaacaaagagtgctgatacaacatcaactgatgactcacaacaagataataattaatgaattgggactgtgacataagccaaattactttcataaaagacaaatggcgcagtacaccaatggcctccaatgcccggtaaaaccgaacgttggaggcctattgttgcttgcgggggctcgaaaaacgaagtcacgagtgacttctgtctcgctcccttttcattaaaagcctcttaattaaaaggggtataatattagttatcaatataaaggatggtgggtaaaatgaataatccacggtttaaatacccagatacaaaggcatatgaatttgtagtacatcgtttagaagaacgcggagtaaacttagaagagcttgcgaagattgtgtatgagacacaaaagggctttgagccagatttgacgttggaaatatgtcaaaaatttttaattgatacgatgcataagcgtgaattattaaatagtgcaatggtagcacttgaacttgatcggttaaccgaagaaggaaaagtagatgaacctttagcaggtattataagaaatgatgctggggtgtttggggtagatgaaaccctagctttacaaattgctaatatttatggaacaattgggacgacaaactttggttactttgaccgggttaagagtgggattattgccaaatttgaccatgataaggttcatgtaaatacatttattgacgatattctcgcggcgattgtggcggctgtttgcggaaagattgcccaccagtacgcttaattaaaaaaatatcattgacttttaaatgatttatcattaaaatgaacgtaattcgtttagaggagtaaagcaaatgagttatcaaactttacaattaaatcatagttggcaaagccggtaactcagggatagctgtagtacagatatgacctgggtttattcgcagattatatctgtaccggctactttatcatgtacaaataagggcttgtacggattccacgtacgggctttttctatttcactggataaatagtgggagttccgaaacgtggagctcctttttattttgaaaggtggagatagggatgaaacgaattatgggctatattattattggaattgttgtgattggcggttattttggacttttaaggcttcatcaacagactacaaagccagtggtaggaattttaacaatgatgcatcatccagcattagatcagattcaacagggggtcgttgctggattagcagaagaaggataccgaaacggcaagaatatcaaaattgaataccagaatgcgaatggtgatcagggaaacttaaatactatggcgaataaattagtgaatgatcatgcgaaagtaatcgttggtattaccaccccagcttgccaagcacttgctaatgcgaccaaggatattccaattgtgatgggcggaattggtgatccggttggtgccggcttagtaaagaatgaaaaacacccagaaggaaacgttacaggggttcatgatgtaaatccgagtgaacagcagattgccttagtaaagaaatttataccaaacataaagactctgggagcaatctacacatcgagcaatacctcttctgaaagtcagtatcgaacaatggtaaaagcagcgcataaattacatgtaaacttaaaaacttatacaattgcgaatgctaatgaacttaatcagacttcacaaacaatgttgagtaaagtagacgcggtcattgttcctagtgacaatacaattgccggatcaatgggagtattggtgaaaaatgcggatgcggtcaataagcctgttttccctagtgctgatacaatggtaaaagatggtggagtagcttatattagtcttagccaatacgggcaaggaaaagcagccggaaaaataacagcacgtattttaaaaggtgaaaagccaggacagatggcagttaataattaccatcatggagaaccggttcttaatttaaagcaagcacgtaagttaggaataaaagttccagcagattttcaacgagaagcagaacaacatggaacagtctttaagtaagatagtgggaaaattccgaataataagaaaaattgaagaagataacattcgctaggtaacattctgttgtatacttaccacagattgtgttgtaaatcgttagaaatacgttaaaataataatgtgaaattgcttgtggataagtcagtggataactaacagtaaatttaaagtaattttataaatgttggtatatcaataaaatttattgttcaaaacttatccacaagttgaatgtgtatttgtggataagtggaattctttgtataatccctgtaacaacgcttacgggcccaaggtattacggaatcattactgaacaattgttcctgtagataactgtggataagtaatttttaagaaaacgctttttcaacaaaaaattaaccgaacattcgggaaaagtaaaaaaatctacactggtctgtggataactttgtggataaactgtggaaggtagtggatatcttgaatataaaaattattggtgtgggtaagttaaaagaaaagtattttaaagcgggaattgctgaatatgctaaacgacttggacgttattgtaaatttgaaattgttgaggttcctgatgaaaaagcacctgaatctttaagccaagcagaaatggatgaagtaatggcaaaggaaggggaacggattcttgataaaatcaaagatcgcgaatatgtatatgctttagcgattaaaggtaaagaacgttcttctgaagagtttgcaaaagaaatcaataaattaacaacttatggtcacagtgatattacttttgtgatcggcggttcattagggttaagtccagcagtattaaaacgggcagatgcccaaatttcgtttggacgttttaccttacctcatcaattaatgcgtttagttttaagcgaacaaatttatcgagcttttaccatcatcaatggtctcccatatcataaataaagaatttcctgagttttggttagattattatttatcgttgttagcgatggtatagtgtaaatatgaagtgtaatggcataagaattaaaggatttgatttaaaataggcatacgaggttaccaagtaattcttttaggggtaatggcaggaatatgcattttagtgatgcaaggaaaagcaagtgcaatgatagtaaatgaagcacggctgacattgcctaatgaaaaaagaattgagtatgatgaatttgaacggtaccagtttcgggcaaaacagttacgaacttggtggcaagtcaagcgaccaaaatataaaattgattggtcattttatcataagaaacgaggatactgggattagctcaggtcctcgtttttcttttaacttttcaaaaaagctattaaaatgaagatattaaaaggaggcaatgataatgaaaaaagttgggattatagtcggcagcgttcgtccaaatcggcggagcatgcaagtagcaaactggttaaaagttcaattaaagaaaagtacaaaggttcaatttgacatcatcgacctaaaagaagttaatttaccgatgatggatgaacctaaaattccttatttgggtttatatgttcacgaaaaaacgcgtaaatggagtgagttagtacaaagctatgatggttttgtgttagtttttccgcaatacaattggggctatccagcagttttgaaaaatgcgattgattacttaggaaaagaatggcaaggaaagccggttagtttagtaacattcggtggacatggcggctcgcaagcacaaattgcaatgaaattggtcgtaaccggcttaaagatggcggcgcttcctgttgatctacaagttaacttgctgccagatgattcaacttcaaccgctgatcggaagttgaatacttataatacgcaagcagcgttattaaagactgcctttgaaaatgaattaagctaatttgtgattaaagtagcaaattattgtgggacattaatataaaattgattcaatttgtgaatattatgacaaacatcgtgatattgtagcagattaggcaagattattattacaaattgggcgataatgaataaaaaatcaaaatgtttctattgcaaaactaaaacgcttgcatgataatggaatcgtattcaaatgccatgaggagggtatttttaatgaatagacaatttgatttcttaatgccaagtgtgaacttctttggtcctggtgttattgctaaaattggtgatcgtgcaaagatgctcaatatgcacaaaccattgattgttactactgaaggtttatccaagattgacaatggtcctgtaaagcaaaccgttgcttcattggaaaaggctggcgttgactatgccgtatttactggcgctgaacctaaccctaagatccggaatgttcaagctggtaaaaagatgtaccaagatgaaaactgtgactcaattattactgttggtgggggttctgctcacgactgtggtaagggtatcggtattgttttaactaacggtgatgacatttccaagcttgccggaattgaaacattgaagaatccacttccaccattgatggctgttaacactactgccggaactggttctgaattaactcgtcacgctgttattactaacgaaaagactcatttgaagtttgttgttgtttcatggcgtaacattccattggtatcattcaacgatccaatgttgatgcttgatattccaaaagacattaccgctgctactggttgtgatgcttttgttcaggctattgaaccatacgtttctgttgaccataacccaattactgatagtcaatgtaaagaagctattcaattaattcaaactgctttaccagaagtagttgctaatggtcacaatattgaagcacggactaagatggttgaagctgaaatgcttgccggaatggccttcaataatgccaacttaggctatgttcacgcaatggctcaccaactcggtggtcaatatgatgctcctcatggtgtttgctgtgccttgctcttgaccactgttgaagaatataacttaatcgcatgtccagagcggtttgctgaattggctaaggtaatgggctttgacactactggtcttaccctttacgaagcagcacaaaagtcaattgacggtatgcgtgaaatgtgccggcttgttggtattccatcatcaatcaaggaaattggtgctaagccagaagactttgaaatgatggccaagaatgccctcaaggatggtaatgccttctctaacccacgtaagggtactgttgaagatattgtaaagctttatcaaaaggcttacgatggcatctactaataattaaataaacacaaagaggctggaaatcagctcagtctctttactgttttacgtattaaactgccagccaaccttacggaggtgggactatgaactagccaagctaattctgtccccctctttttttgtctacttttaattcttaatattttgaatttttttcacaaagttacttgcaagcgtattcttttgaaactataataaaaattattctaagagagaataagaggaaaagagaaaatgatatatttacttgctttaattccagcaattggttggggtgcgatgccattaattactggtaaaattggtggttcaccagttaatcaaatgtttggaatcggtgctggagcttcaattgtgggaattattgcatatttgataacaaaaccaaccgtcagtgtaactgctttttggttctcgctagcgatcggttgtttatggacaattggacaggttggtcagttcatctcgtttaaacatatgggagtttcaaatacgatgcccctttcttcagcatttgtgttagttatgacgtcgtttgtcggcatctttttctttgatgaatggcaaggagccagagcattaagtattgggttgacagcgtgtgtagttgtaattattggggctgttttaacctcgatttcggacggaacatcggataaaaaggtttcgactaagtgggtattatttttattagtaacaacaattggttactgtgcttattcgatttttcctaaaatgccacaggttgctcatgaaagtagtcagggtattttcctaccagaagtattaggaattttacttggttcagtaatttatactatttgttcgggtaacgctaaagcatttaagcaaaaagaacaatacttaaatattttaggaggactttcatgggggattggtaactttgcctatgtttttgttggtaaagctcttggagtagtgactgcttcaatttttggtcaaatgaatgttattatttcaacatttggtggtatcctacttttgcatgaaaccaagaccaagcgagaaatgatatatacagtagttggaattatcctaattgtaattggtagtattttaacagtaattgctaattaattattgaagattttaggtaatatcaataaatgagagaggaaacgcgcaaaatcagctttttaaccgattttacgcgtttttttagtcttatattatttcccaggttatattgtgctatttcttatcaagtagatcaaacctaatttgtccaagttgtaatttttcaggttgtttagccccgtggaaaatcagtttaaataatcgattttcaacgccagccttgaaaacaagttgtttatcgccaatattaattgtataggtgtcaccttcacttactacttctgcctgcaagagggctgaccattgtttagcagcctcttctggatcactaacattaaagattgcttgcttaacaaaaaggtcacctgccggatggaatttaattaagccctgtttcttgaggtcttcccggcgttgatcatcgttgttgccccattgaataaagaatggtgcaggtaaatggttaacaagttcatcattgacatagaaaatcttccattgaataagtttaccggcaggatccacgcgctttccatcagtaatatcaccaacattaagccccagaccctctaatcgctggtgagtttcttcaatattgtcagtctgaatggcaattgttgtgatgcgctgaataccagcaaaataatcttcaacggcatcatgaattgctgagttattttcatatgggaatgccttagctttttccttattagcgatggttaagagctcaatgtaattaaggccaaaataatctagtgcattttttgttccccaatattcgtgatgtccaccaggggtaaaggctaaacctttagagttgaagtaatcaattgcatcttgaaggttagttacatcaaccattgtatgatcccaatttaacgtttctgtcattttaatcacccttgttctgtttgcctaattcctttgttcgtttaacagcagcaaggacagcattttcaattcccgctgaaaaagtgcttttatctagttcatgctgggcggtgatacccactccgccagcagaattattaatatcaagtaattcggcagggtgtttaccactttgttctacaaatgcagcggctgcgcgtagattctcaagagcaagtttgtttgcttgttggcgaggcattccggcaagcacacctgcgtttgtaaaactaattagaaagttatagatatagtttggtccagccacgccatatccagtaaatacatctagcaaggattcatcaatgtaatcgacttttccaaaactatttagaaagtcttcaatgacagtttgattagctcgattgtttttaacgacgccgctataacccatggcaacatcagtcaaggtattggggatgatccgtgtaattgcaaaaagatcttcctgagatgaaagttgtgcaactgttacgccggcaataattgaaagcacgtccttttggtagtggtgggcgacaagttctttcatgatctcttgccagttatcttgtggacgcactcccagaataacaagatcagcattctcaacagccgtccaatcaggttgttgacttgcttgaatatgataagtatcagtcaaataattaactcgatcgctcgaaatatctgttatcccagttgtttcaggagtaattacttttttcttcagtgcagcccgcagcattgcttccaccatttgaccaccaccaaatgagtaaatcttaagtgtcattgaaacatcatcctttctatatgtacctaacctaatcgtagcgtatttcaaactaagacgctaatttaaacacttctttcaaaaaaataaattcacaaattggtctacttgaaattaaattaacaagaaagcgtttgctgtataataaaattgttagttagaaatataataaaagggcttttatttgttaaaaaacaaacttttcaatatgagataattggatttttacggagtaatattagttgaattggtctattaaatagttgtaaaatgtaagcgtttatttaagggggaaccattatggcatatcaaagtatcaatccatttacgaaccaagtagaaaaaacgtttgaaaatacaactgatgaagaattagaacaaacattaactacggcgcatcaattatatttagattggcggaagtataatgaccttgaagaacggaaacggcaaattttaaagttaggtcaaatattacgtgaacggcgtgttgaatatgcgacagttatgagtaaggaaatgggaaaattaattagcgaagcagaaggcgaggttgacctttgtgcttctttctgtgattattatgcagcccatgcagatgaatttctgcaaccaaaaattattgcgacaacgagtggacgcgccaaagttttgaagcaatcattaggaattttagttgcagttgaaccttggaatttcccattctatcaaattgcccgggtatttattcccaactttattgcaggaaaccccatgatcttgaaggatgcgtcgaattgtccagcatccgcccaagcatttaacgatgccgttaaggaagctggtgcgccagccggcagtttaactaatttattcctttcatatgaccaagtaaataaggcaattgctgataagcgggtagccggcgtttgtcttactggttctgaacgtggtggtgcaaccgttgctaaagaggctggtgctaatttgaagaagagcactttggaacttggtggtaatgatgcctttattatcttagacgatgcagattgggatcttgtcgaaaaagttgccccggcagcccgtctgtataatgctggacaagtatgtacatcatcaaaacgttttattgtccttgaaaaggattatgatcgtttcttaaagatgatgaaagatgcgttctcgaaagttaaaatgggtgatccccttgatccattaacaactctggcaccattatcatctaagaaagcaaaagaaaagctccaacagcaagtcgcaacagcagtagaaaatggggccaaagtttactatggtaataagccggttgacatggaaggtcaattctttatgccaacgatcttaactgatatcactccagataacccaatatttgatacggaaatgtttgggccagtggcttcggtttataaggttagttccgaagaggaagcaatcgaactggctaataattcaagctatgggttaggaaacactatctttagcaatgattccgaacatgcggaacgagtagcagcgaagatcgaaactggaatgagttggattaatgccggctgggcttcattaccagaattaccatttggtggtgttaagaattcaggttacggtcgtgaactcagcagttacggaattgatgaatttactaacaaacatctaatttacgaagcacgacaataaaaattaatcaaacaacgcaaataaagggatcgcaagtttggattgcggtccctttattattacctgggaaattattgaattcttttcaatacaatcttgcaatattatctcactgcttatatactcagttgcataagtaatcaaccacaaaattgctatttggaggaacattcatatgactgcgaaaagaaacagccatcataaatctcgattacgacaattatttgcaacacgtcgacgtcggtggattggcatcggtggcctaattgtaattataattcttgtattagtttcaattcgacatgcaagtgaggaaaaagcaacagaaaaaaatgaatataatatcctacgggttactgagcaatcagattttaatctgacaggaaagatcgaaccagtccagacgcaaacactaaccctgccatctggtaccctgcaaaatcttaatgtgaaaaatggggatcacgttgcgcaaggagaagcacttttgaccatgcataatgatagtacacaagatagtgttactgaactgcagggggaccttagtaaaagtcaacgaacaatgaatgctcaacaacagacaatcaataatttacgccaacagttgaatgggatggggcaaggtgatgaaggatacaatgatctgcgcaatcagcttaccgaggcacaaaatgcatatgcagacgcacaagcaagtgttgctgctactcaacaacggcttaacaccgcttcaagcaaggttaatcaaacattaacagcaccttttgctggttatgttacggttgatcaatcaaagcaaaatgctcctgtaattaccctttactcggatacgcttcaatttgtcggtcaaatctcggaatatgattatagtaaacttcatcaaagtgctgatctaaaggtaaaggccttagcaacaaatcgaactgctaatactcaggtaagttatctttcaacaattccaactaaaaatagtggaaataataccaaatatgaagtaactgctaatgttagtgctaataaatttatggcggggcagacggcaaaagcttctattaaacaagatggggtccagatttccaaatcagctgttcgtcatgggaaggtatttgttgttgattcagacaaccgagttcgcgagacagatgttagtggccgggcagtcaacagctcttatattgtgactgatggcgttgatgctggtgatcggattgtgactaaccctaacagtaagttgaaaaataatgcaaaggttgattaatatgatcaagctaaagaacattaataaatattaccgtcaaggtagccaacgttttcatgttctccatgatattaatgttgacattgagcaaggcgaattagtagcaattatcggtgaatctgggtcagggaaatcaactttgattaatattgtgggctttcttgatgatgattttgagggaacatacttctaccaaaatcacccaatccatgattattcgcgaaagcagttttcaaatttacgaaatcaaaatgtcggttttgtttttcaaaatttcaaactgctacgtgggtcaaccgttgcagataatgttggattacccttgctatatgcaggaaaacgacgccgtgaaattggcgaacgggtttctgaagtcttagagcaagttggtttagccggatatgaagatcaattccctaaaaacatgtctggtggtcaacaacaaagagtatctattgcccgggcaatatcaacgaacccgaaatttttaattgctgacgaaccaacgggagcgcttgatacggaaacaagccaagaagttatgaatctttttaagcgattgaatcacgaagaaggaacaacgattattatggttacccatgatcctcatgtcgctgaacaatgtgaccgaataattaaaattattgatggtcgaattgtgagtgacagtaaaggcggtgaatatcatgcagacaattgagttgatcaaatcagctatccagtcattaaaagcgaataaaaagcggagtttcctaacgattattggaattatgattggtattgctgcagttattgctatccttggaattggggacgggattacgaaaacgatgtatgataagttcggtaataatgctaagcaaggccagcaaacgattgaaatcgtctataatcctgataatgttaattcgaccgtcaatggattcactcaggaacaagttgctgatattaatactcaatttggtggtgaaattaaaaaagctgagattgagcaggaatcagataatctgtcaacacatgcagatattggtgatgcgactaaatcagtgacattaagcttattaaagaagccaacccgtgacgtgaaattcattgcagggcataactttagtaaacggacttttgaactcggggatacgaatgccttgatgagtgaaaaagtagctagacggcaatatggttcagcacaaaatgcgcttggcacaactgtaacagtaaataatgtcacctataaagttacgggagtatataagtcacaggcacagttcacggatgatggaaatcaaaactcatatggtgttgatttattattaccgaaaaaagtttactatcaaggagatagtgcaaaagaagggaatacacttaaattaacctttagccaaggtgtaaatgccagtgctatttcccgcagagtcgcaaaatacttaaaaaataatagttcggcagcgacccaaggatcctatcaatacctagacatggaaaaagcccttaagcaattctcttctcaaatgagtatcattactactttcattagttttattgcggcgatttctcttttcattgccggaattggggtaatgaacatgatgtatatttcagtttctgagcggacacaagaaatcggaattcgcttagctgtgggggccacaccatttaacatcatgatgcaatttttagtggaagcagtaattcttaccatgacaggtggattattaggctttttaggtggtgcaggattggcgcacttactagcaccgcttttatcaagtgcgattggtggtggtggcattcatattcacgctcatatttcacttaatgctttcttattggcatttggaacatcggcagctgttgggttgatttttgggatcttaccggcacgccaagcagctaataagaatttgatcgatatcttgagataaaaaaatcctcagttttttgctgaggatttttttacgaattctgtagaaaacactacgaatcctgcaaaacgtaaaaactattaaattatcgagtataataaaaagataaattaaagttaaatattaggagataggaaaagatgagtaaaaataggggtaaattaacggttatttcattgctagttgtaattattgtggtatgtggggtatatatattattacacccatcttcatcaaagaaggttgctagtgaaagggctactaagacagagacgattacaagtagctcatctaaaaaaacataaagcagccaaagaagatagttcagataaagttaaagatgatgactctgatgattcgtcttcagtggctgatactaatgatagcgaggcaacttctgcatctaccgcagcaaccagtggtaatcaaacagcccaacctgcacaaagtcaaaatacaacccaagcaacggcggtaagtaattctggtcaaactgctagtcctaaagctactactaataactataaaggaaaccgcagtgtcgccaacacaaataaccggcggacagtaagccgaaagacaacccaaactgtatcaactcaacaacctgtaacagtggaagatgggatgaactttagctaccgggctgcgtaaaaagcgggcgtgattgataataatacatctgttgaagagttttacaaaaatgccaaggaaggtaatggttctgtaacctacaagggccaaactatttactacaaagctaagggtaataatcaatatcaagttacaactgctaaatagtttagttactaaaaagtgtccggtgtttttgccagacgcttttttagtaaaaatactatgaaaaatgtaaaatatactaattgtttacgctttagtatataatgaatgagcgtaatgaatatgtttactaagtgatcattcagtatagaaattatacttaaagatttggatgttatgggagtacttttatgcaaaaactatctattaaacaactaataataattacattgtgcttattagtgctggtggttggctgcatgactattcaccagcgtcgtcattttaataagaacgttaagattgataatgtgtcggttggtggattgactgctaaacaagcattaaagaagttacaagataatccacaatcgccaaaaatttatgttaacaatgagttagtatttacggataagcaatcagtagcaaagtttagtagtgctgacgaacaaaaaattaaaaatgcattacatagtcagtatactttcttcccatcatctaaggcaaagaacattgcgattaagcctcaaaatgttaatcaagatgaagtatcaaagattgatcaagcagtcagtcaaaaggtaacagaattaaataatggtcgaaaagctcctgttgatgcttacgctgtatacgaaaatggccgagtacaagtaaaaccagcagttggtggtactcaatacagtttagatggtttgcataataaagttgagaatgagattgctggcggaactatttacttgaggccagtatacaaagctccgctttctgcaaatagtaaaactgttcagaatgaaaaagcaaagctcgaagaattatcaaaacgatctgtaacataccaagtacaaaacaaaaagtaccaattaaattgtggtgagattattaccagagcaacatatcaaaatggaaaatatcactttaacactggagcagctaattcaaagattgatgaaattaataatacccaagcaactcttggcaaatcatttgaattcaaaacacatgatggatcagtgatcaaaacaacagatgctggctcgtatggttggaagatcagtaaaaaacaagctggaaagactcttacgaatgcattggttgcaaataagcaaacagtaaacgccaaaaatgatatctatggtaaaggttataatcaacaaggaactgggtataatactacaagcaacaatggtataggggacacttacgccgaagtttcactagccgaccaacatgcctggttttataaagatggtaagtgtgttcttagtactgatattgttagtgggacgaatgataaaggaaatgagacgccaaaaggtgtctggtatattatgtaccagcaaacaccgtctatccttcgaggccttaacgatgatggttcgaaatatgcaagtaaggtccaatattggtcaccatttactgatagtggatgtggatttcatgatgcaagctggcgtcatgactggtcaaaacaagcctatctcgctaaaggtggcggatcgcatggatgtatcaatatgcatccagatgttgctggtcaagcctttcatgacttacagaaaaatgagcctgtaattatctactaaaggagaatttattatgcgcccaagtgctgaacgttcaataatgattgcggttgtttgttttatattaacaattattatttcattcgccttgtctgagggatggataaagtagggatttaacgatggacttagaaaagaagaaaaatttggtaattattaatctattttatattggattgattttgatttactgcattttacatgcaggaccgctgaatttaatggtgtttttgggtatgttagtggttgcaaatttaatggggatgttaattaaataatgggttagaaagtgattgatttaactttaccacaagcattcgtttcggactttttaaatgtttttgaactaattattatttatagattagtgacgggttatttgaacaggaaaattattttagttgatttccttgcaagcttagttattatttgcgttccttttctagaaggttcattagagtttccattaataatgatacatttgtggctatttgataggaaacatgatcgtccgcaaattatacataataatattattgctatgtgtacaataattgtaatgatttcacttactgatttaggtgatcattatatgtatgaaatctttttggaaggtagaaagaatatttcgttattaggatggatattaccaattacagatcttatcctcactgttatagtaggaatattggtaatactttttattgctcccaaagttcgtgaagttagtatacaaattttgaatcccgttccactttggaaataagtaggggtattcttgtattttacaaacgacgtttaaaaagtaaatggctgggaagaattttttctcctcagccatttttcaactaatcaacttttacaaatccatcttgaacaaatttcgttccgtaggtcagagtgttttccacgggacactttgcggcaacgtcagcgagaaacttcttaatgtcttcatcagactcgctgctgcgtaggtgtggttggtaacggatctcagtaaacttacgaacattcttgccatcagcaacgtcttcacgaccaagatcaccctcgattgttacccaaaaagctcgtaagtcaaagttacgctttttagctaatgcttgggcagtgattgcctgacaggcaccaaatgacgcaagaagaatttctactggattcatccccgtattagtactttctggctcatcaaaggtaatttcaaaaccacgggtacctgctgaaacttgcatccccgttgttgtcttagttgctgttactttatatttactcataaccgttccctcctttaatacccatagtgtaatcgagacgatacttttggtcaatgagggtgctcaattataaggtgatttcatgtggtgatttttcgctattaaggattgtcatcacatcatcaagtgaaatatccaccatgtttttgactgctaaattagtaaagaaggcaatatggggagtaagaatgacattatccatttcgtgtaattctttaacaaggggctgatcatcaagccctttttctcggcgatccgcagctgcaactgtttcttcaccttcaaaggtatcgagggtggccgcggcgatttcaccagattttaatgctgtgacgaggtcagctgtattaacgactggaccacgactagcattgaccaaaccagcagttggtttcatcattacaaagtcgttagcggtcagcaaacctttagaagttgggtttagatcaacgtggagactaacaacatcggcttgctttagtaattcttctttagaaacgaactggacaattccatcgaggtcagtgcgcggattcgtgtcataaccaagaacagtggcaccgagggcattaagaagtttagcaagtgttccgccgatacgcccgaccccaataattccaatccttgccgtgtgaatttcggttgactgttcatcgctaaaccagcggaagtcattttcggcgacttggtggtcaaagcggtaagttttccgaagcaaccggaaaatctgcattaatgcaaactcggcgacactccgcggtgaatatgctggtacattggtgacgactaagtcattttcgttagcctttttgatgtcgaccatgtcaaatcccgcggtccgagtagcaatttgtttcagaccattggcatgtagcttttcataaatatcagccggaactttactacgttgctgaatcacgagtccatcaacatcggccgttaattcaacagcatcgtcaatcaatttcggcgttgtgatgatttcgatattatgttctttcgcatattcgttaatggcggtttgttcatcgtcccgcatactagtcatcaagattttcgtcatgttaatcctccttattaatgaaggccgcaatgttatcaagagctccggttagattttccatactggtggcgtaactaattcgaacatatccttggccgccagctccaaagaaggaaccgggaatcacagcaacttttccttcattagcaagatctgtcgcaaatttaaggtcatcattaccatattgttcaggaatcttagcaaaaacgtagaaggctccttgaggattaatcaactcgaatcctaatttttggaggctattaacaacaaagtctcgtcgttgctcataggcatctttcatttcttgagtagctgcttttccttcgtcagtaccaaatgcggctactgcagcggccattgctggattagaagcagcggttactaacattgcgtgaatggcactgaccgatttcatcaattcttgcggcccagcgataaaaccaattcggtaaccagtcattgcgtgtgattttgaggcaccatttaaaattagcgtttgttcggggatgtaattagcgattgaagtatgagtagctccgtaaacaagttcagagtaaatttcatctgcaattacaatcaggttagttgatttaaccgtatcggctagtgctttaatttgatcttgggtgtaagtaacaccagttgggttggaggggtagttaagaactagtccctttgcattaggatgttcttctagtacgctttggagtcttgcgggtgtgagaacaaaatcatcgccgcttgtatcaacttcaatcggaatcccaccaagaatctttgtaacagccatgtagaaggggaaagttggggttggaatgataatttcgtcaccgggattaataatagtagaaagagaagcgaaaattccttctgttgcgccaactgtaacagcaatttcgttttttggatcgtattccagtttgtaacgatcttgcatgaagtgagcgattgcttgacgaagtgcgaaagtcccatttcccggagcatagtgtgaatcattggcattgatgctttcgattgcggcctgcttcattgcggctggcacattaaagtctggttcacctaatgttagtttaatgatgccagggattgtgctgacttgatagtcaaattcgcggatcccaccaggagtgagtttagcgaaattattgttaagacgactaaggatttcttttttagtagctggcatgataaattcctcctatataaatatgtagatttagaaataaaagaagccctgaatgctatagaaataacatccagggcttcttgatcagattggaatgagtataaaagaggctctcggatgtttgggggtcatccgggaacatcacaatgataaaatcactgctggttagcggacggtaatcgcgctaaaccagaagacatacgcttgattcaagtgaattgtcgcggtgatcatcattgtgtcctccttttgattaactgattattaataattctaattgttctttaatttttgtcaagcgttgattgagaaaaactattaattacaaaattatttattgattacaattgtaaatataataaagctcgaaaatatttgtgattattagttcgcatttaatttaatatttaatttatattctacaattttttttattttttcgcgccttttttgttgtgttactccacaagtgtgatataatattaatcgtaaaggaagtgggtagcaatgcggatcgacatcaaacattatttggaagttaaccacttgaccatttatcaagtttccaagcgttccggttacggctacacgactttacacaaatcgtttaacaaaccacagtctagttcgacctcgcttaacctgcgtgaccttgatgccttggctcgcgctcaagacaagagcatgtgggaggtccttaaagaactagaagagcattacctcgaatgagattgtggcattgctgtagccacaggaggtcaaatgcattaatttttgacttctagaatacttagactacgaaacttagaaaataaaatattatatttaattgaggagggattgcatatggctcaaaacccaatgaatccatttgacaacgacatgaatgacatctttaatcaattaatgggtggcatgaatggtttcaattctgataatcggcgttacctaatcaatggtcgtgaagtaacaccagaagaatttgctgaatatcgtagaactggtcaattgccaggcggtgcaaatcctcaacaaggtgggcaacctggccctcaacctaacgcaggtaaggacagtatcttacacaagttaggtcgaaacttaactcaagaagctcgtgaacatgaacttgaccctgttattggtcggaacaaggaaatccaagaaacagctgaaattttaagccggcggacaaagaacaaccctgtattagttggggatgctggtgttggtaagactgctgttgttgaaggtttagcacaagcaattgtttccggcgatgtaccagctgctatcaaggacaaggaaattatcagtatcgatatttctggccttgaagcaggtactcaatatcgtggtagttttgaagaaaacatgcaaaagttggttgatgaagtcaagaaggctggaaatatcatcctcttcttcgatgaaattcaccaaattattggtgccggttcaactggtgattctagtggttccaagggtatgtctgacattattaagccagcattatcccgtggtgaactaacagttatcggtgcaactactcaagatgaataccggaacactattatgaaggatgctgcattagcacggcggttcaattctgttactgttaatgctccaagcaaggctgatacagtggccatccttaaaggtatccgtgacttgtacgaacgtcaccacaatgtaaagttaccagatgacgttctccaagctgctgttgattactctgttcaatacatgccacaacgcgcattacctgacaaggctatcgacttaatcgatatgaccgctgctcacttagcagcaaagcacccagcacgtgatgctaaggcaattgaaaaagatatcgaagcagaagaaaagaagcaaaaagcggctgctaagaaagaagattacaaggctgcccaagatgccaaggaaaagattgctgacttgaagaagcaattgagtgaaaactctgaatctgaaaaggttactgctactccagaagacgttgctaaggctgtagaacaaatgactggtattcctgtttctaagattggtgctagtgacgttgaacgcttaaaggacatggacaagcggcttgaaggtaaggttattggccaagacaaagctgttgaagcagttgctcgtgctattcgtcgtaaccgtgctggatttgacgaaggcgattcaccaattggtagtttcctcttcgttggacctactggtgttggtaagactgaacttgctaagcaactagcccttgatatgtttggtagcaaggatgacattattcggttagatatgtctgaatactctgaccggacagccgtatctaagatgatcggtgctactgctggttatgttggttacgaagacaacggtaataccttgactgaaaaggttcgtcgtcacccttattcaattattcttcttgatgaaattgaaaaggctaatccacaagttatcaccctcttgcttcaagtacttgatgatggtcggttaactgatggacaaggtaacactattgactttaagaatactgttatcattgctacatcaaatgccggctactccaacgatgctccagttaagatgggccggaacgaagatgaagaagacttaattaagaagttgactacttacttccgtcctgaattcttgaaccggttcaacgctattgttgaattccacagcttgactaaggaagacttgaagcaaatcgttgacttaatgcttgctgaagttaaccggacattggctaagaagggcatggatgttaaggttactgatactgcaaagcaataccttattgatgaaggttacgatgaagccatgggtgctcgtcctcttcgtcgggttatcgaacgtgaaatccgtgataaggtaactgattactaccttgaccacctcgatgcaaagaatcttgttgctgaaatgaaggatggccaacttgtaattgttgacgctaaggacgcctcaaaagacgatagtaaagaatatacttcaccatctgaaaagaaggatgaagaaaaagacgataagaaggaagaagacaagaagtctgacgaagataagaaagacgaaaagtaattttcctttaatgtagaaaaagacataggatgactctgaaatgagttaacctatgtctttttttgctttaaataataaacattattaatgatctaggcaatcactatggaggctaaaaactaattaggaaagttgaaaattgatggtaagatctgattttatgcataaaattattgggattaaggttaaagtgaattgcctaaaaatgtcgaaaaaatagacaaaaataagtgaaaaaatagtctgttttggtgattggcttatcaatccatttattcagacaacaaatatattagcaatttatgattagttaaataatcaatagaccacaagtgctattatatcaacgtttgttcgaattaccagctgttaaataagggctgaatagtgattgtttattaccccactttatctgtatcattctttcgcggttgtctctaaatgagacatttggacaaaaatgaaacagggataatttactgattttagtgtaaagataaattcgtttagtaacttataattatcgtgggaacaggtttgaaaaaatttaaattttttgaggggtttttaaaatagttttaaacaataaaaatgaaatattgatacatactatttgctaattgattagtaattaaactttgatataaaggcattttaaccatggttataaaaatattcgtctgattaatgaatggctatttcgctaataaggaaagcaacttaacaggtgaatagttaaaacgccaaaaggatcttttcaaaaattgtctctcttgtaatccctaaaaaccttgatatagtaggaactgttaagtcattaagcaataaaccttgcatgaataatttattttcttttgaatattttttcataaacgggggtttattaaaatgagaaattcgaatacaaataattggcgttcaactgctttgattgcgggggcaatcttgacagcaggtgtcgttaccaccacttcaacgacagatgtacacgctgataatagtcaaaataatgcacaagtaagtaatgaccaagttacttacgaccaagttcgggcaactgctgatcagcaacttgcacaattgcaatcagctaatgatagtaaagaagctcaacaagctacggccaacgagcaatcaaatgctgcggatcttgcacaaatcaacgcacaaattgatcaattaaaagctagtcatgctgctctagaacaagaacaagccggtgctattgcacaagcacaagcttctactgctgcttctattgaagcacaaacttcagctgctaatgctgaataccaacaacaaattaacgcacaacaacaaaacgaagccactcaacgtgcagcaaatgatcaacagtacgcacaagctgttagtcaagctgctgaaaatcaacaagctattgctgatatcaatgcacaatatcaacaagctttaagtgatgcagctaatacgcagacaagccaagcacaggctgctgtcaataattacaactcagctgttgctaaggaaaatgatgcttaccaaggtaagctatctgctcaacaagcaactaatgcagaaaatgttaaaaatgctgaagcatctcttgcaaccgcaactgctaatgctaacaagccttatgaagttgcaactactaacgatgttgctgttactggccgagttgctaaaccacaaacagatgttaaggttcctgactatgtagcaaaatacggaattcatctagaagttcgtggctataatggtgctattcctgtatctgattatacttatcctgaatttgctaatacttactatggtgaatatcctgatagtgcagtaattacaaataaggctgctgactcaactccacatgatatttcagagatgccattagatttccaaccaggtctattaagttacgatactaaaaatgatcattcagaaaaagtttctgctgatggattaacagctgcccaagttcaagtattacgggcattagctctttcatgggaaaatggattccgtaacaatgttttccaaaactaccgtgaattttacaatgcggttaataagaatgatggctttgtgaacgttgctccagttgatttagtaagcactgactttgctgataacattgctaaccaagttgttgctaaccggacaaagtacaatgttgataataatagtcatactgttatcagcagtggaatgcctactgaagcaacttatagtagcattattaataatgccacccaaaacttgcaaaagagtttaacaagtgaatttaatggtaagacagtttacactgacgttaatgaaaacttaactactatgcaagctgggacgccaactcttctaaattacgctattaatctctacaactcaatgcagggtatgtactatggtgaattggtaaacccaacacacatcggtggacatgcagttaatcttcttcgtgctggtgttcgcactgtgggaattggcttccaaaagctaactgatgaaatgactgctaagaatggttcaggtgtttctgatcgcaagaacccatcatatgctgtaacatttgatcatgtcggatttaacattgatcacgatgttaacttaactaaagaagttcaaaatcgtaatgtatggggaacttcaactgtagatgcacaattaaatgctattaagactgctcaatatcatgttaataaagtaccggggacaaagacagttacgccaactgctactgatgtgcaaaaagctactgctagcgaacaacaaaaattagctaatgttaaggcacaagcacaacaatctcttgatgcattagctagtgcccaccaagctaacttaaataagcttgaacaacaatataatgatgcgaaggctcaagtaaaagctaactatgatactgcagttactaaggcagctagtgttcgtgatgctgctcttaaggctactggagctgttgaccttcaagcttacaaggctcaattagacagtgcctaccaaaacttagtaaaggctgatcaagtagccgcacaaaagcttgctgctgatcgtgacgctaagatcgctaatattaagaaaactgaaaatgcaaagcttgatgctaagattaatgaacttgttccaagcattgacccacaaatcaagcaattgcaagatcaacaccaagcagttattacccatggtgatgctgttcttgctgaattaaaggctgaaaataaggctgcttataacaaacttgctgaacaattcaacgttcaattagcagctattcaacaacgtgaagatgctaagagagctaatgaagttcggttagcaaataatactgttgttcttcctacagcagtgaaagcagctaatgatggcaatgttgatactgttgctttcccaacggttacaaaccgtctacaagctgaaactactggacgcgttcaaccagtttcagcaccatcgattgtaaagacagctacgcaaacgccaattgcagttgcaccagttgtaacacaaacagctgcagttgctgctactacaaataatggtacacaaacacgggttgcttctactgctgataataaagccactaaagcagacaacaatgaaaaatcagttgtaaaagctgacactgttgctaagaagcaaactcctgctaagaagagtgaatcatcacaaaaggttgatcaatcttctatgtcaattgttgctttagctgccactgcattacttggtacactcggtatcacttacagctcaaagaagcgccacaactaatccaaaacggttaataaatacaaagaggctgggaacttcccaacctctttgttgtttaaaaatgtcatttctttgtgcgtcctatagcttatcaatcaatggttgcataaaattattattgattcgagtaagcttatgatggcttcctaagtttagttcataggctaatcgctcgggatcattttggtcattaactttaatgattcctcgtcttttaaagttgaaattttcgacaatgtgttgcatcgctttattgttgcggtgagtgtcgatccggaaattcttaattccttgcatttggccaactgttagcaagttagaaaagagcaatttactaagtccttgtccgcgataattactgctgatggcaacccggtgaatggtagcgtaaggttcatctggttgttgccactgtccctgtgtaatgttacgataagtcggttctggggtgagctgaagggtcgcagttgccgctactttattaccattaattaatacccagtttgtttgcgttgcaatatcttgagcaaaagtttctcgatttggataaccgttttgccattgcggactgccatttttctttagaaggttctttgcatcatcaattatcttcatgattgccgctaagtcttgggcctgggcgcggcgcaaatatatttctgccattagtatcctcccttgattaataatatttctattgtacgacatttagccttattcagcggagaaaataggcgagattatatttcagaaagaagtggtttgcgttagaatgaaaagcaatgagatgaatggaggataagcgatggcattaacatggacaattatttggtggtgtttgctactggttattctcgtcaatgaaattgcagccatttatactgttttccgtgaaaaacgagatattgccgcaacttgggcatggctgttagtgttaatgctgattcctgggattggttttattctatatgctttctttgggcgaaaattaccgcataaacaattagcccgaataaaatcacaaacgcagctaaaattaaaacaagcactagaaaagcagaagcagcaattcatcaatatgccgaagcccaaagaccaaaccgtccagatttatcgacggaccatcatgctttttcaaagtattgatgactcgtttttgacgcggcacaatactgttaatatttttacaaatggtaatgtgctttttaagcaaatgtttgatgatattgcagctgcgaaaaagagtatccatattgagttttatacaatttataatgatcaaattggtaatgaattacgaactctgcttgaacaaaaggcggctgagggagtagaggtgcgagttctttacgattcatggggatcaatgggagtctggccaagtttctatgatcatttacgggaagtcggtggttatgcagccccgtttctgatgtcccgaagtaatttctttgattttcggataaactaccgggaccaccggaaaattgttgttcttgatggtgaaattgggtatgttggtggttttaatgttggggaccaatacctaggacgcgttcctaaatttggtccatggcgtgatacccatcttcgaattgtcggcggtggcgtttatggtcttcagcgacggtttattggcgactggaatgcatcaatgaagaaggataaagataagattgtgcattaccatccttactttcaaccaattagagttcatggggatgttgcattgcagactgtctctagcggtcctgaagcgccattggaaaaaattaaaatggggtatttacggctaattaatgcagcgcaagatcatatttggattcaaactccttacctgatccccgacgatagtattttggatgcattaaaagtagcggctcattcaggaatcgatgtacggataatgattccgtcaatgcctgaccatgcctttgtatatcgagcaacgcagtattatgctcgtgagcttgctaatcatggtgtaacaatttattactatcaaaagggtttccttcacgccaaaacaatgatgattgatggtcggatggcttctgttggatctgctaaccttgactttcggagttttaaattaaacttcgaaattaatgcctttatttataatcaaaatacagtagacgatcttgagcagatttttgttaatgatattcgtgaatgccgggtaattacacctgcaatgtttgctgagcaaccgcgctggttaagagttaagcaaacggtgtcacgtctgctgtctccaattttataatgatagagggagcgagccagaagtcacgagtggcttctggctcgttcccgttttttagctaaagaatatatgttcgttttatgataaaattagaggagcaatttaagcgatagaaaggattaaagattatgggaacactgggatttgttttaggaacagcagcgatggatcatcagcaagtattgattgatcaattagttgaccaggtaaagaatacacctgctgatgacaccttttattatttggtgcccaaccatattaagtttgaaactgaaattaatgttcttgctggtcttcgtgatcgccaaggacttagtgggagtgatcggttcgcctcttcacgcgtacaggtactttcatttagccggcttgcttggtaccttttacgagatactccagcttttcaaaaacaacacctttctaaaattgggatggcgatgctaacttctcaagttgttcaagaacaggcaagtgatctccgtttatatgcgagcgaagtaaaacaacctggctttattcaaaagatgacagctcagcttgaagaattaaaaaatgccaacataaccgccgatgacttaactgatattatttaccgggtgaagtccgcgaatgatccagcagctaatcaggcgtggctcgctaaaatgtatgatgttgaaactatatatcatgcttatgaagcccggttgcgtgaccggtacattggtaatagtgagttataccggcaattagtgtcttaccttcaaaaatcaccagaagtcgctaagatgcacttctttattgaccgttttgctcagtttactgcaaatgaacaacaagtagttgatgcattaattactaatgccgcatcgacaactatttctttaacccttgatcgtggatacccagaccagaatcatccaaatccccaggaacttcctcctaaaaataatttattctattcctccgcgatgcaatttcaccgtttgtggaaatttggtcaaatgcatcaaaaagaagtgaaggttttgcaaaatgtagcgtttgcgacaactcctcgtgttgatgcggaattacaacaagttgattcgtattttaagcgttatgcaagtgaaccaattggccccggcgagcgagaagagcttcttgatccccaaaacattcaatttatgacaaccactaatcggatgactgaattaaataatgtggctacccagattcgccaattagttgctagtggtaaatatcgttatcgtgacttccttatccttagtcgccaccttgacggctatcaaacaatgattgaaccggtttttgcggcacataatattccagtttttaatgatcatgaacgcttgatggataatcatccgctagtaacgctcctcacaacattattagaattaccgcagcgaggctatcgaacagcagatatcatccaattgctgaagacatggttacttgttccacggacaggcactggtgatctgatggggctaagtgatttccaagcagcagtttttactactgagaattggtgccttaagcaggcaattgagggaaaaaatgcttggacaactaatgatccagaaaagattaagcaattatggcaggcgcccggaacgaacctgacagatccaaagtatgaacagtcacgtttagaaaaattaaatgaccagttagcccttgtaaaagattttgttgcaaaccacttactgccagttttcgaccagtttaaacaagcacaaacaggacaagaacttgccactgcgttataccagttcttagctgccatgggagttacagaccggttatatgcttggcagcaataccagagtacccgagatttagatctcgcgcgccaaccacaacaagtctggactaccttttgccaaattctccaagaatatgtggaaatcttgggccaacaagaactacgagatggaactaatgaggtccttgcagatttcagtgaattgctccaggcaggttttgcggcggcccagtattctcagattccggcaacgttagaccaagtggtagtctctgaaactggaattgtccaaagtgaaaaccgaaaagtagtttttatgattgggtcaactgatgatgtgatgcctgagatgcaagaaagtgatagtttgctaacggaccaagataaggatattttgagtgcttatcttgatgaagatttccaataccttcctggaacggcaattgaccaactgattgatgagccatttgtccactatactggctttatgaacgctaaggaacagttgattttctcggcaccgcaatcagatagtgatgataaggaactcagtatatcgccatatatgcacgatatggctcgctactttggtcaaccggttcgtgaatatccattagctactagcaaggccggacaagacaatgctattgattttgttagtgccccgcttgcaacaataaaccggttagttgaagttagccgacaaattcgtgatgagcaaggggttggcattgatcgtcaaccggtcatgcctgttggatggcaaacagttgctgaatcgttggttaagttagctaagcaatggcaacaatcagcggatgctaaggttcaagcagaaggaatatcactaggtcagcgtctatctttagttgctgctggtttccattatcaaaataagattgattccctgggaaataaattggctcaggcactttatctccgggcagctccagatgatgagcgcgggcgggtattatatgcctcgatttcgcagttgcaagatttttatattaatcagtacgaatatttccttaagtatggcttgaggttgcaaaaacgagatgagttaaccttatctaatgaccgtatcggtaccttcttccataaagcaatggagacttttgttacaacaattcgagaaaataatttgtcatttgcagaccttgcccacaaagataatcagatgcaacgtgaccagctgattgaccatgcattagttacagcgcaagagaatcagccaactttattgcgtctcattaattcttcagcccaagcccaattccaatatcagcaattaaccgccattgttaaaacaatgttaattacattatgccgccaagctgaatataccggctcgcagccagtaaaaaccgaagttcagtttggaagaattggtaaccaacagccgggcaaccttggttctcttgattatccgcttaaagataatcatcatatttatctgcggggacgaattgaccgaatcgataatcttaagcaaggaaacaataatttcttgacggtcgttgactataagtcgagtaatcatctttttgacctcacttcggcttattatggactctctctccaacttttaacctatcttaacgggttacaggcaaacttaactgaattggaaacgaataatcctcgactggcaggggcattatatcttcgtttgaataatccgacaattaaggctgctgagttaaagaaaagttcccttgatgatttgaaattaaaagagcaccaatacaagggaatcctcttgaatgatccacaattattgcgggagttagataagagcttagataaacaagcattcttatacccacttaaggaatataagaatggaaaaatcaaagctaataaagaagcgcttctcgttactccgcagcaacttgattggctgcaaaacatgaataaggaacttgtaattaatgcgggtaatcaaattttgagtggtgacttgaaactgaatccttaccggttattaactggaagcaaccgccgcacaggacttgattatagtgactttttagatgtatttcagtttgataatatgcttgaccagcaaaactaccgcgacttaaatcctaatttagcaaaagaagcatttgataatgtagtccaagacgatgatgaggaggataagaagtaatggctggatttaaaccaacgcctgctcaatccaaggcgattaatgaccgtggcgaaaatatcctagtttcagcttccgcgggatcaggaaaaacggctgtgctagtaaatcggacaattgaattgattaaagaagggcaaagcattgatcgaatgctgctcgtaacatttacggatgcagcagcaaagaatatgcgggataaaatcagggcagccttgcagaaaatagtacaagattccgctaatcccaaagatttacgtgaccggatgagtaatcaaattaaccggcttgcggctgcagatatcagtacaattcatgctttttgtttaaagttaataaagcgctactactacttaattgatcttgacccacaatttcggcttttaactgatgaaacggagcgattattacttcaagaagatgtctggcatgaagttagcgaagaattatatagaaatgctgaagaaaaagtttcgggaaaagcttcctttagcgaactagtcctcaacttttctagtgatcgtgatgaccaaggactcgacgacttgattttacgattatatgaaattgctaatgcccagcctgaccccgaaaagtggctccaaaaattaccagataattatgatttagggtcgggctcactattagaatctaatttttatcaacaacagctaaagcccctagtcatcgaaaagctcaatcagttcattcaagattatcgtgaattagtaacaagagctagtgataacggactagaccaagcagccgaggttattaagagtgatgaagagttgatgcaccaacttctttcttcactaggggggattaccgtcagtgatgtttgtcaaatgatggcgcagcaaaagtttggtagttttcggggacgaccagcggcagatgatccacggattgatgtatttaaagacattcaaaagcagcgtaatcagctaaagaagcagtgggaacaaatggttagtacttacttgggaaagcaggaagcacaggaaccaattgcaaaagaagagctgctaactgagctaacgactttcagtgatcaatttacagacttgttaagcaaagcaacggaaagtcaattagacgctaaaactgttgattcattgcaaaaagaccagcagatgatgcaggagcttttagacttattgcagccacctacttggaatactattcgggacctatttgctaatgctaaatttgcacgaatgggtggtaaaccgaaagacgatgagctagctgaggaagtatataaatcactaggaagtgctcgcacagggataaaaaagcaatttgatcagttagtcgatcgcttctttaattaccgtgaagaccaatttcgattaatttcaacgcatgcccaggaacttttacgcgaattgagcgcggtaacgattaatttccgtcggcgataccaacaaactaagctgaatcggcatgtccttgaatttagtgacttggagcactacgcgtacgccattttaacgccaccagacgaccagccaaactggcaaacccttgtcaaagatctgcaaaatcattatcaggaaattatgattgatgaatatcaggatacgaaccgtcttcaggaaagtattttgatgaaattgacatctcctgaacgcaagaacctatttatggtgggggatgttaagcaatcgatttaccgcttccgtgaagctgatccaacattatttctcgggaaatatcaaaactatcgtcaaggcagcgacggggaagcgattgttctgggagaaaatttccggtcgatgactaatgtaacgagctttaccaatattcttttcgaacaactcatggatagggaagttggtgaaattgattacgatgaagatgcccatttaaaatatgcggcaacttattacgaagaaaatcaagataataaggttcacccaacagaagtgttactgtatgacgctaatgcccttgatccagaaaaagaagatgttgaacatgaggatgataaattagctggagaatttcggatgatcgggatgcgaattaagcagatggtcgaaaatcaagagttaatttttcatccagaagatgggcagatgcatccaattcagtacggtgatattgttttgcttgagcggacaaaggcaattaataattcattgatggaagagtttaataaacttaatattccattgacagttcacgatgttgaaagctattttcaagctactgaagtgcgagtaatgatgtccttgttgaagataattgataatccacaacaggatattccattagttgcggttttacggtcaccgattgtcgggttaactaatcaagaattagcttttatccgtcttcagaatcgatctgtcgattactacgccgccttgcaaacattcatgagtaattaccagcgaaaggctcttcgccatcaatcgcttcttacttctgaacaggtaaatgccctttatgaaaaagcagatcacttcttaggtttgcttcgtgtctttcgacaaacagctcagcaacaaacccttgttgacttgatttggcagatctatgaccaaacaggttaccttgattatgtcggagcaatgccaggaggccaccaacgacaagcaaaccttcatgccctttaccaacgtgcgcactcctatgaacaaagcagttttaagggcctttaccaatttattcgctttattgagaaaatgcaggaacatgataaagatttaggagtagcaccgacacagttaactgcaaatacggttaatgttatgacaattcacggaagcaaaggtcttcaattccccgtggtctttctaattgatgccacgcatggttttaacaaaggagcagctcgtgaaaatgcagttgtcgatgctgttgccggggtaggaattcgttacatggatgatcaacgggtcatttatgatacgccacaacgacaagcagtgattgaagaaatccagcgcggcgaacgggcagaagatcttcgagttctctatgttgcactgacccgtgcggaacaacgattagttattacgggatcctttaatgaagaaatgcggacacaaagtcttgctgggtcatggcagcggtggcaaaaagcttatcagagtaagaatttactaattggcccgcagccacggatcactgcaaattcatttatggactgggtcggccttgccctggctcgttatccagaattcaacgcgcaacaattgagtcgtggaaatgtcacgttagaagaaagcacacttgctgatactaaagttactggtttggcggctgatcctcactttactgcaaaaacatataccgcacttgatgttagcgatggattggcaaaaattgggcaaaatgctagtgctaatgtaacggaaaagaacaatacagtcgcaactgatgcttctgaacaaaagattgagcaaattttgcgctatcgttacccccatcttgtcgctactaaaacaactgcttaccaatctgttacagatgtaaaacgagtctttgaagatcctgatacacgtgatatggcgcggtgggattatgatcaacaacaaaaggtaaagacacaagggatttatttaaataataactttgatgtcccggctttcatccaacagactactcatgaaccagtagcaacagaaattggaacagcaactcaccttgttttccaaaaacttccgcttgatgaaggcctgattaacgttgaatttgttgatcaagaaattcaaaaattggtaggagaaaaattgatcaatccagttgtggcagcacggatcaatcgtgagggaatagtggccttttatcagaccgctgttggtcagaagatcttaaagcatcccgcagattatcatcgcgaagtacccttctcaatgattatgaatggtcatgaattatttaaaggggtaaatgttagcgatgatgagcgtattttaattcacggaatcattgatggctacttaagaactgacgagggaattattctagttgactataagaacgatcaccttaataaagattaccgcgactttgatctggcacggataaaggaccgctaccggggacaattagagctctacaaagaagctttgaacctaatggaagggattccagttgtccaaatggggctttacctgttagaattaggagagttcgtgttatttacaaaagagggtgattagttggcgacaattaaagatattgcacaaaaagcaggggtatcggtttcgactgcttctcgagctttaaaccataatccacgaattagtgaaaaaacacgacaacgaatagcgacgattgctaaagagttgggctatcaaccaaattacaatgcacagaacctaacacggggcgaatcaaacatggttggaattatttttccggtaaccagtgatacagcacctgccaaccctttccatattgacctgttacggggaattagcatggcattaaagccgattcactatgaaatggttgtggcaattgcgccaactacgaccgaccttttacaaagcgtaaaatcgatggtcgaacagtcgaaggtgcataactttttagtactttatacggttaaggatgatcccattactaattacctgcgccaaaataaccttaattttgtggtaatcggtcacccggataaggtccaagatcgctttgtcgacaatgataacgtagcggcagggcaagcggcgactgattatctgatggatcatcaggaggtcagtcaccccgtctttcttcaatctgcaagtaattgggcatttgaacaagataggcatcaaggttatgagcagagtatgcaaaatcatcaacttcctgctcttagctggcgatattcaccaacggggaccgcagttaaagattttattaaacaacatccgcaaatcgattcaattgtttgtgttgatgacttgttactggtacgattaatacggcaactacaagaatttaatttaccaactatttgttttaacaatagtcggttgatggggatgttaattaatcaagaagaaaaggttgacttacaaccccgcaaattgggtcagcaagcggtcgaattgctttttaatccagaagagcagtatcggattgttgattttaaaataaatagttgatagaaaggaccacggaattatttgccacggtcctctcttatttttacatggagggaaatcggaatggagaaggtttacattgttgctgctcagcgaacaccaatcggtaagtttaacggtcagttagcttcaaagtctgcagttgaattaggagcgattgcaattaaagcggctgttgaaaaggcaaagctcagcgaaaacgatattgaccaagtgttaatggggaatgttattcaagcaggaacgggacaaaatccagcgcgtcaagcatcaatggccgctggattaggtgagcaggttccggcaataacgattaatgacgtctgtgcgtcgggaatgtccagtgttgacctggcagcaagtttgattcgcgcaggacaggctaatgtaattgttgccggggggatggaaagtatgtcccaagctccatatgttcttcctaaggcacggaatggctatcgatttgggaatggaaccttgcttgatgcgatgcaaagtgatgcattaaatgatgtttatggcggttatccgatgggaattactgctgaaaatatcaatgataagtatcagattactcgtcaccaacaagacgaatttgctttgatgagccaccaacgtgcggtaaaggctcaaaaagcaggctatttcgattcagaaattgtaccagttgaagttaagcagaaacgaacaacagtgactgtaactgttgacgaagctccacgaccagatacttcactagcggctttagcaaaattaaaaccagcttttaaatctgacggaagtgtgactgcagggaatgcctcgggaattaatgatggtggagctgccttggttcttgcttctgaaagtgcagtcaaccgattaggattaactccattggctgagtggcaaggatctgcagttgttggtcttgatccagcattgatgggtttgggaccatattatgcaatcaagaagctcttaaaaaatcagcagctgtcggcagatgacgtagatacttacgaaattaatgaggcgtttgcgacccaagcccttgtctgtcagaacttgcttcatcttgatcctagggctgtcaatccttggggtggggcaattgcattaggccatcctgttgggtgttcaggagcacgaattatcgtcacgatgattagtgaaatgcatagggataatcatgaactcggcattgcttcgctgtgtgtcgggggcggaatgggtgaagcggttctgcttaagaaaatttagtaccaagaataactttcatcgtaaaaggcaagtaattgaggaaacttgaagtttttctctattacttgccttctttattttattaagctaaatatgttttaaataattaactataacggacctgcttggcggaaactaaacagtaagaactttaaattataaaaatctgcaaccgttttctaaaattttgcgcaagcggttgcgcaaaatttttaaatttgatattattaatattgcaataattcatgaagcgcttacaataatcacaagtgtcttttagaactattttataagttaaggagttgttagcaatgagtcaagaaaagtccacgggggctggattacctactctatcaaagagtaccatctggatgatcaactttggattccttggtgttcagacagcttttactctgcagagttctcaaatgagtcggattttccaaactattggggccgaccctaacaaccttggctggttcttcatcttaccaccattagctggtttgattgttcaaccaatcattggttattattcagaccgtacatgggcactaaaattaggtggtcggcggttgccatacttactattgggaatgattgtagctgttatcgttatgattttgcttcctaattcaggaagtttcggtttcgggtatggttcgcttgctgccctttggttcggtgcaattactgttgctttacttgacctttcatcaaatgtggcaatgcagccatttaagatgatggttggtgatatggttaacgatgaccaaaagagttatgcctatgggattcaaagtttcttatctaacacaggtgctgtgttagctgctgttttcccatttatcttaactgcttggtttggggttcgtaacactgcaaaacgaggcgttgttccagattcagttattatcgccttctacgttggagcagccttgttagttgttactagtttgtttacagttttccgggttcatgaatatgatccagcaacttatgcaaagtaccatggcattactgaagatgacaacaaagaaggtggaaactggtttacacttttgaagcatgctccaaaagcattctggacagttacccttgttcaattcttctgctggtttgcattccaatacctttggacatactcagctggtgctattgccaaaaatgtttggaatactgttgatgctacctctgctggttatcaggctgctggtaactggtacggtgtgcttgcggctgttcaatcaatcgctgcggttatttggtcatacgtattagctaaggtgccaaacaagtaccacaagcttggttacggtggtagtttacttcttggtgctcttgggttcatttcagtgttctttgttcatgatcaatggacgttgattgtttcatacacccttgtcggaattgcttgggctgcgatgaacacttacccattaacaattgttacaaacgcattgactggtaagcacatgggtacataccttggattattcaacggttcaatttgtttaccacagattgttgcttcaatattgagttttgttttattcccattatttggacactcacaagttcacatgtttatccttgctggtatcgtaatggctcttggagctctttcagttgccacaatcaaggaaacttatgctgaataggagttatttaataaaacaaattaattaagttataataaaggcaggttaaagactacctttatttcagatgaaaggaattgagatttaaatgaaacgtacatttgatattgccccttggcatgttgctactcacaaatgggacccacaagacaagcgtttacaagaatcaatgactagtttagccaatgaaaatcttggtatgcgtggcttctttgaagaaggttacagtggtgaccacatggaaggtatctaccttggtggagtttggttccctgacaagactcgtgttggttggtggaagaatggttatcctaagtactttggtaagatgatcaacgctgtcaacttcatgaagttaatcattaaggttaatggtgaacaactcgacttagcaaagcaaacaccaaaagactttaagcttgatcttgacatgaagcgtggtgttttagaacgacgctttactgttgaaattggtggtactgaaatgtacttcaattttgaacgttttgttagtgttacccaaaaagaattagttggtcaacgtctccacattaagaaccgtggcgacagtgatgctaaggttgaaattaccagcatgattgatgctgatgtatataacgaagacgctaactacgatgaacaattctggaacgttttaggcaagtctgctgatggcgaacatgctgaattaacttctatgactaagaagaatgattttggtactccacaattcatcgttggaatgaagactacttcaaagactaaccttgaccacgtagatgatggtactgacgaaaagcacgcttacaacacatttgctggtactgtagctgctggtaaagaagttaactttgaaaagcgtagtatcgtaatgacttctcgtgattacgattctcaagcagatattgaaaagaacttggatgtattaggcgaccaacttgataatcaaagttttgacgatttactcgatccacatattaaagaatgggcagatcgttgggttaagtctgatgttgaaattgaaggtgacgaaggagctcaacagggtattcgtttcaacctcttccaactcttctctacttactacggtcaagattaccgtcttaacatcagtccaaagggattcaccggtgaaaagtacggtggtgctacttactgggatactgaagcttattgtattccagtttaccttggggttgcagacccagaagttgcacgtaacttattaatgtaccgttacaagcaattagatggtgcctttgttaacgctaaggaacaaggacttgatggtgcattattcccaatggttaccttcaacggtatcgaatgtcacaacgaatgggaaattacctttgaagaaattcaccgtaacggggacattgcctttgccatttacctttacactaagtacactggcgacaagtcatacgttcttaacgaaggggcagaagttcttactgaaatttctcgtttctgggctgaccgtgttcactactcccaaaacaagaacaagtatatgcttcatgccgtaactggtcctgatgaatacgacaacaacgtaaacaacgactggtacactaaccttctttgtcgctggactcttcaatacacccttgacatcttagaccaagtagatgaaaaggtagctaagaagcttaatgtttcagaagacgaaaagcgtaagtggaagggtattgtagacaacatgtaccttccttacgacaaggaaaaggacatcttcccagaaaacgatggcttcatggacaaggacttgactccagtttctgaaattccaagtgaccaattaccacttaaccaacactggtcatgggataagatcttacgttcaccatacgtaaaacaaggtgacgttatccaaggtctctgggacttcatcgatgactttactaaggaagaaaagaagaacaacttcgacttctacgaacaatttactgttcacgaatcaagtctttctgcttccgtttactcaattatcgctgctgatattggttacgaagacaaggccgttgaattgtatgaacgttcagcacgtcttgaccttgataactacaacaacgatacttctgatggacttcacatcacttcaatgactggttcatggcttgatattgttcaaggatttgctggtatgcgtgttcgtgatggtcaattacactatgcaccattcttacctaagaagtgggattcataccaattccgtcaaatgttccgtggtcggatcttgaaggttaaggttgacaagcatggtactaagattgaccttgtatcaggtgacccaattaccattgatcttgacggtaagaagcttgaattaaagtaattcttggaggcatttgagatgaagtttgaagatttgaaaggttttgcatttgaccttgacggtgttattgctgacactgctcgttttcatggtcaagcatggcaccaattagctgacaaggttggaactgaatggactccagaattggctgacgcattaaaaggtgttagtcggatggattctttggaattaatcttgaaggctggcggtcatgaaaatgactatactcaagaagaaaaagaagctttggcaactgaaaagaatgataactatattaaattagttgaaactctaacacctgccgatattcttccaggaatgaaagacttcttagatgaattgaaagctaacggttaccacattgtattagcttctgcttctaaaaatgcgccaaaggttcttaagtatttgcaattaactgattactttgaaggaatcgttaatccagcaaacttaagccatggtaagccagatccagaaatttaccaagaagcagctaaattaatggatcttccagctgaccaagtagcgggacttgaagatgcccaagccggaattgaatcaattaaccgtgctggtgaattatcaattggttttggtgctgatttgaaggatgctgatgttaagttcgataagactggcgacgtatccttagctgctattaaagcgcaaatgaattaagatccaatttctctcttttaacaatccgtaaagacgtacttagaataatctaggtgcgccttttttatgtgaaattatgaaaagaaaagtaattataacaatcattattttaattagttgcttatgggtggcagttacaattaactttaatcggccttcctctcagcaagttcaggatgaaacacagtcaagtcaacagccacggccaaaatttaccgaccaacaaattggggttttagcgggattggcaatatctcccgagtggttaaaacaaaatattgctgcaaatcaactcgtttatggaattgttaagccctctgacaccgttccagcaggggtagatgattatagttatttagtagccgctgacgaccaagatgggacgataattttctttaaagcggaaggacaaaccgtgattataaaatatacttctcagcgaaatacaaaactaaaagcaaaggccttaaccttatcgcaattaaaaaaagaattttaccaaactaggtcacaaaaaagagaagtagacgactacgtagcaggattgcggaccgaataaaatttaaggcatcttaaaaatgctatttttagggtattctttagtggtgagtactgtataatattcaaattaaaggaggaaaatgtgatgtcaatttatggcccatatgagcagattttgtcaaatattctttccctcacaactgatcggatcaaagagctaaatcggcaaacagtgcaggataagcaaccaaaactttatgaacatttaattgctcgggtgaagacttccgagagtatggcggaaaaatgccaacgaaaaggctatccggtctctactgaatcggccttacgaaaatgtcgcgatgcagttggaatcagaattgtttgtaactttatcgatgatattgaccgttgcctttgccaattacgtcaagctgactggtgtgaggttattaaggaaaaggattatattacaaatgcaaagccaaatgggtatcggagctatcatgtcattattgatgaaaaagttccatatcaagatattgaaggaaataacccgggacatttttatgttgaaattcagttacgaacgattgcaatggattcatgggcaagtcttgaacatgagatgaaatataaacataatattaaaaatccagagcgaattggtcgcgaacttaaacgttgtgctgaccaattagcatcatgcgacgttcaaatgcaaacaatccggcaattaattaattctagtgaggaaggcgaataagatgcgaatccttgtagcagaagatgaacagcagctatctcatgtattaagttcagcgatgacagcgagtggttatcaagttgatattgctaataatggccaagaagccgttgagcaggcgaaagaaaatgcctatgatgtcataattttagacatcatgatgcctgttaaatctggactggaagcattaaaggaaattagagcaactggtaatcgaacatatattatgatgttaacggctatgggtgaagaagatgataaggtaactggtcttgatgccggtgctgacgattatttatctaagcccttttccttaaaagaactacttgctcgtttgcgttcccgtcaacgccgagatgattcttaccaagtagatgttcttgaatttggtgatttgacccttaacggtaacgatcaatcgcttgaaagccataattcgattagtttaacgaatcgggaaaatcgtttacttcagtattttattttgaatgctaataaagaattatcagcgaatgaacttattaaccacgtttgggatgagaatgaaaccgctgatcaagaagatctctggattaatatctgttatttacggcaaaaattacaggcaattcaatctcaagtaacaattagtggtgaaaaaactggaccgtttatgattgcatgctagggggtcaaggaatgattcaacgttttcgctataaatttattgcaatctcaactgcggcattattatttgtaattttgacaattgttggcagtatttgcaccctcacttactatcaatcgcaccaagaaattgaacgggtattgacgattttggtaaataacgacggccaaattccccgaaaagggatccggactactgacaatagtcaacctcaattttcacgtgagggccttcatcaatatcgttattttgctgtactggttgataataaaaatcaagtaacggaagtgcaagatgatcatattgcaacggttacgccgcaggatgcccgagcaatgacagaccgtcttgtaagaagaaaagtgcatagcgggcagttgctatatcgaggggtaaattatgcttataagattcggaataaaaacggcgagaaagtaattgtctttcttgatgaatcactcctcatggcccggacacgatcactaatgcatacagggttgatcttaggggtaattgttttagttctgtataccattgttttaaccctttactcgcgtcgtgcaattcggccaattattgaagcagagcagcggcaaaaagaatttataactaatgctagtcatgaattaaaaacgccattgacagttatttcagcgaataatgaaatgcaagagattatcaatggtgagaatgaatggacaacaagcaccaagcaacaggttactcgcctgacaaagttaattaataacctggtgtcacttgcgcgcatgcaagaacaaccgacattaacgatgttgccggtaaatgtaagtcaaattgccggggatgtggctagtagtttcaagagtgtgatttcaaccgaacagaaacaattcaatgtacagattgatgaaggcttggtagcaaacgctgatgaaaatacactacgggaactgttgaatattttgcttgataatgcgaataagtattgtgatcctcagggtgaaattgattttacagtgtcctcgtctaatcatagtaaaaatatagttattacgattgcgaatagctataaagatggtaaaagcctggatgctaaaaaattctttaaccgcttttatcgggttgatgaatcgcatactcaaggaaaaaaggcaggctttggtattgggctttcgatggctcaatatatcgttaaacaattcaaagggaaaattacggcgaagtatacaaatggtaagttagcttttatcgtaacgttaaaagaagtaggaaagtaagaatgaaattttggcgacttaagattggaatatatgcagttgtttggagcctaataattggtatgctgacagcggcgtatttaaacttagttaactgggtaattgatttagtttggcatcaatacctagatccggcagttagtagtaaatggtatccgtttttagtatgtattccattgggatttttgattggtttcttgaatgagcgatggggtaattacccgttaacgattgaacaagtgctgacgcaagtaaggttgaaggggcaattaaattatcataattggtggaagtcttttattcttggcttattggccctcggagcaggaggaagcatcgggccggaagcttctacaacagtcttaactagcagcatgattaattggcttggtgaccgtatgcgctgggcaacttcaatgcgccagaaagtttctctttggtacggtaaaatgcaaacgcaagatttagcccgtgctcctagattcagtcagctttttaaaaataaatctcaacgagtctttgttatttcaggattagttggaattggaatagtaggcgcggcgattgtttttaagctttttcctgaagaaggtgtttttgggattcatcaccggatcattaattgggagtggatcaatttattaacgagtattccaacgattatcattgggattgcttttgggtggctgtttgttcacttagaaaattgggctgcactgataattaatgcaaaaataagtaagatttggcaaggtgggatttttgggttaattttagcgatcagctcgttgattacaagcgatatcttattttctggtgagtttagaattgttccttttacccacgaagccttcaatcattcaatcatcttcctattagttgtagcactcgtaaaagccgtaatgagtaatctgggttttgcaatgggatggcggggaggaactattttcccggctatcttttcgagtgtcgcggtaggaactgcctgtgcgatgatgttgcctggagacgtacggataaatgcaattgttgtaatcgcggcaagccttacctttattttagaaaaaccgttattaacaattatcccgctgttattattggtaccaattgaactagcgccggttataattgtagttgcatttttagtaggaaggattattaaactttttcctgctagtgaatagagaatctttaatatcttttgtgtaataaagaagattgagtacttgctaagcgtgaaaaattatttaaattttattttattaatattttgttgtttatatgagaaaagtcctgtatctttattaaaaagcaattagagaatggggcgataatgtgtttagcagaattggtcaattaatattcgataatgaagctgttgcaaagacttctgattttacaatgggtcttgagattgaaatgcaacgagtagacgaagatggcaacctaagccttgagccatatccgtcagcgattggggatgagaagactaatccatggattaccaatgattttttagaaacaatggctgaaatggtaactccttctgcccaacatgctcttgatgcaatgcattatttgtatgttatcaataatacattgcgatcagctcttgctcccggcgagttattatggccgttatccatgcccccacgacttcctaaagataagactaaattacggttagctaaaatgggaccgaaaaaagaagcttatttgaaggaatgggcaaaacgtcatgggtactcgcaaggaacgccttgtggagcgcatattaatttgagtattgatcagcacattattgagctagtccttaatgctttcccggaacgctttaatagtgagcgtgaagtgcggaattatttatatactatcttggcacaaggttttgtccgatatcgatggcttcttacgtatctttatggtgcaagcccaattgttgaaggaaattattttgaaccgggaaaagagttgcctcatccgattcggagtgtgcggcaaagtcaatacggctttgggatcaaatttaccggtgattttactaatctcgatcgttacattgcacggattgaagaaggagttaaagcagggatcttaacatcggattacgaatttcatggtccggtgaggttcaaaggaaacacggatttaaaaaagttgcctgaacatggaattgagtatttagaattacgaatgctcgatttagatcctagcagttcagtaggagttcgaactggtacactaagatttattcgtttattagcaagttacttgatcatgcagccaccattaaaagaaaacgaagtagaagaaatattggtgactgccgataaaatgaatgaagttgtagccgaggaaaatccccaagcaacttgtagatatcaggccaaagctcgtgctgtcctcaaaagtttagagcggtatgccaatcaaatccaactcggtccagaatattccgaagttctggaagacttagaagatcgggtcgaaaatccgttaactaccccgagtgctaaactcttaaactatgtaaagaatggttcactcaccgagtatgcgttgcgtcgtgccaaacgttaccaacaagcggcacaggaaacaatccatcctttcaaagggtttgaagatggacgaatctatactgctgatgagcttcgaaaagaattaacattgtaaccttttcaaggagaagctagctccagtaagcaataataggcctccaacgttcgattttaccgggcgttggaggcctattattaatgtctttagacctggttgagtgcgcgagcagagcgagtgcacgaaacaaaaaaccacctgctatgcgggtgggcgataaaaattatataaaaaaggcctcttttgccttaagatgtaggtgttcaagccaaagtcaataagggaaaagaggttatataaatatggctaataaattaaatagcttagcccatacgaagtggttatgtaagtatcacatcgtattcataccaaagtatagacgtaaagcgatcttcaatcaataccgaagagacctgagagattatattcgtttgttgtgcaaatataagggagtagaaataattgaaggtcatatgatgccagatcatgtgcacttgttagtaagtattccgccgaagctaagtgtatcgcagtttatgggatacttaaaagggaaaagtgcattaatgatgtttgatcgacatgcaaacttaaaatacaaatatgggaaccgacatttttgggctgaaggctactatgtaagtacagttggattgaatgaatccacgataaagaagtatatccgagatcaagagaaacatgatatagcaatggataagctaacaagtgtggaatattcagacccttttaagggtaagtgaggtagtacaaacaccgcttaaagcggtggcaaagtagtcagagcattttggcttgagcaaagcgaaagccagcgccttgagacgccggcttttattatcggcttatagccgatgtgcaaaccacccgtttgacgggtggttatgattctatgtttttttctgaaagtaacttagcttatgtcacagcccctccactatttatttaaccgcttttttcgctctagcaattaagtcagcaaaaatagcgcgcgaataatcgtaatgtttaaacatgttttctggatgccattgaactgctaaaatttgatcagagttaatggtttccacggcttctggtacctgatcatcagcccatgccgttacatgaagtggttcagcaatctgatttagtgattgatgatgacgtgaattaacatatggtctgggtcctactaagttaaataatcgacttgccttgtctgtattaacgtggtgggaaggaaaatttcctggggcatcttgggaatgcttaagggtttgatggggattttccgaaaggtcttggtataaagtcccgccaagcgcaacatttaatacctgcattccacgacagatccccattattggttttccagcattaaatgcagctgtagcaagactaatttcaaattgatctcgtttaagatatgtgggacctaatttttgatgcggttcttcgttgaaaaaggttggatcgacatcacttcctccagcaaagataatcccatcaaaaagatcaaggtaggatggtgctagtgaagcagcaacactaggaagaataacgggtaatcctcctgacttgataatggcttcgattaatgggcgaggtgcgaaggcagcatttcgctcgttaatgatgtttgtagcttcagttaatgtatctgcaggaatagcaattcgtggatgcatataacccctcctcatttagttctcatgatattataatcaaagcataattcatttggaatagcaatcaatatttttaataaaaaaagatataatagaagaagaaagaaggaatgtaaagatgcttgaattaactaatattaactcaacgttcaacttaaataatgaggtcaagattccctgtgtgggatatggtacatttaggactccggcagatgtagctgaacaggccgtgaaagaagcaattgaaactggttatcgacacattgatactgcggctgtttacggaaacgaagaagcagtaggcaaggggattaaggattcgggaattaagcgtgaagacctttttgtgactagcaagttatggaatactaatcgtggctatgaacaaacgaagaaggcttttcaagagacgcttgatcgtttgcagatggattatttagacctttacttaattcactggcccgccaatgaaaagcagtttggagatgatgctgccaagattaatgctgaaacgtggcgcgcaatggaagacctttacaatgaaggtaaaattcgggtaattggggtaagcaattttatgcctcaccatattgcggaattaataaaaacggccaaagtagcgccagcagttgatcaaattgaggttcatccgggttggccacatacggaagaaattaaatacttacaagcacacaatatcttagttgaggcatgggctcctttaggtggtcaaggtgctaaagtattaactaatccaacaatgattcaaatcgctgataagtatcaaaagacgccagcgcaagtctgtttacgttggattctccaacaggggattcttccattaccgaagtctgtccataaagaacggatgataagtaaccaaaatatatttgatttcgaattaactgatgaggatatgcgcaagattaatttattgccaaatcttggcggtcaatgtgctgatccagatgaggttgatttttaacgataaaaaatatgaaattgatgcagtagtattgggtatccagtcaaataaaaatagtatgctaaaaagtctcgaaccttcacggaagaggcttttttgatataatttcttttagctaataatgaggagaatttgaaaatgaaaaatgcttatcgcgcttttcgccaatactcttgccagttcaggaaaaattggcttgaatatttaatattatttggcggtcttgatattttaaaccagtttctggtaattccattttttcgctggataactacctttgtcctgcaggcaggagaaattccgtttatttcatatcaaaatattgtaattattctgacccatcatccattagttgtagtgagccttttaattgaattaatatgtctaatggtaattatctatggcgaatttatgctcttgttgacgggctttcgtgaaattggcttgccagagtttagctggcgccgaatgtttaggcaaacaaaagaaactttatcgttactaaattttggatcgttaattctattattaggttactttttgcttattattccatttgcggatatcatctttcgaactcccctgctggcgaaaattcaagttcctcagtttattgttgattatcttacccgtaatgcatggcttattggtggattgaccttgttctatcttttgatgacaatgatcggtattcgtttaatattgacaatgccgttaatggcttatcaacatttacggttaagagctgctatgtctcaaagctggcaaatgacaagtaagctaagatggttgaagtttttaattcaaattgtgctgatgacaataattgtaggtagtataacggttgttttttacctcatgatttacattctccaggttgttttggatttattacccgggaaattatctttgattactgctatctttaacttgtcgatcttacagcttggtggggaagtactagcagtatgggcaggaacaattatcttactggtagtcgttaaccccttaactagcattagtgaactagcgacaactcctgaacatccatcacgaggattgctaacttcctttatgcttgtcttccttgtaatcggcttggcgactcttgcaaataatactttttacatgatgggaacggggattaaacgcccaataactatctctcatcggggagttactgaaaaaaacggggtgcaaaatactattccagcaatggaaaaaacaagtaaacttaagcctgattatattgaaatggatttgcatgaaacaaaggatcaccggtttgttgtgatgcacgatgaaaatcttaaagacctaacaggagtaaataaaacacctcatgaactaacattgaagcaattaacacgactaacagcacgcgaaaatggctatcatgctaaggttgcgagttttgatcaatatttagcagcggctgagaaatatcatcagaaacttctgattgagataaaaacaacaccccatgattcaaaacagatgctccagaattttaatcgccggtatgggaaaaggattttgcaagatcatgaccaagttcactcgcttgattacagtgctgtgactaagctaaaaaatattaatccgcggttaacagttttgtatattcaaccctataatttgggtaatccccagggagttgctgacggtttttcgatggaatattcaacattaaatcaggacttcattactcaagcccagtggcaacataaaccggtatatgcatggacggttaatgacaccgatttaatgaaacagactatgtataaccacgctaatgggataattaccgatgatttaggggaattaaatgcggcaataaaagattttactggaaagcagagttatgctaatcgaattctaaattatattattgtcgtgcccacaagtgggggaattgaaccgtaaaaaaatactcgagaacagataagccgttaaggcgatcagttctcaagtatttttatccaacgtgatgcttcttcaattgcctaataacaattaacgccactattccaccgatcattccttggataaagtttgaacctaaacttaaaaaaccagtaattacatggtacataacggtattgcagataaagtagattgcaatcattacgattgttccgaccaagattgcggtccatttgccccaggtggtgttgccatattttttataaatccagccactgataaatccttctaaaccatgagcggcaaaggaaaataaggcatcttgggggaagccggaaataaggtcaaggaacattccgccaaagccaccaacaattgtccctgctcctggtcctaaaagcatggcagcaatgaatacaccagcatcacataagttgacgttaccatgtgtccatggaatagggataagaaagaagcggccgaggacaagagttaatgctaataacattgcggcaataattgagcggcgtaaccgaaaagtagattccatattaaaactcctaacatagtcaattgtgagtaattttacaataattttcaaaaaatttcagagaaaaaatgtgtagttatttatctatcgatacaaacaaaaattaacttaacatcttgtatcatagtaattacattgaaatattatgtaataaaactgataattgattttcaactgataatcaatattcctattttatatattgattaaatgaaaataatgcgtataataaattgtgaaaatcagaacatgatatgaggtgtgtgttatgaaggttattattgttggttgtacacatgcgggaacaattactgccactcaaattttacagaatcatccagaaacagaagtcacaatttatgaacggaatgataacgtttcattcctctcatgtgggattgcagtttacttgagcggtgatgttggtaatccagatgcgatgttttattcaagccctgaacaacttgctgccatgggtgcaacagttcatatgcaacataatgtaactgatattgaccctaagactaagacagtcacagtgacagaccttgtgacaggcgaaacaaagaccgaccattatgataagttagttgatactactggttcttggccagtaattccaccaattgaaggtgtagatggccctcatgtttatttgtgcaagaattaccatcatgctaaagaattatttaacgttgctaaagatgcgcaacgaattgttgtgattggtggaggttatattggggttgaattagtagaagcttacactcgtcaaaataaggacgttacattgattgatgggtctccacggatgcttcataaatactttgaccgcgagtatacggatcgaattcaacaggaatttgtagatcacggcgcccactttgcttttgaccaacgcgtaactggatttgaaaaccacgaaaatggtgtaaccgttaagacggataagggcaactacgaggcagatattgctatcctctgtgttggcttccgtcctaatactgatctcttaaaaggtaaagttaagatgcatgataatggggcaatcattacgaacgaatacatgcaatcatctgatccagatatttacgctgccggagattcaacggctgttcactataacccaactggcaaggatgcatacattccattagctactaacgctattcggcaaggaacaattgttggaacaaatctctttggtaatacaatgcgcgatatgggaacccaatctagttctggcttaaacttatatggaacaacgatggtatcatctggcttaactttggagaatgccaaagaagcgggctttgatgcagctgcggtgacagttgaagacaactaccgtccagaatttatgccgacaacaactcctgtattaatgacattggtgtgggataagaagactcggcaaattcttggtggacagtttatgagtaagcatgatgtttctcaatctgctaacattatttccttatgtatccaggataagcacacgattgattatttagcatttgttgatatgcttttccaaccacactttgatcgtccatttaactatgtaaatattcttggccaagcggcggtaaagaaacaagctgaattagaaaaataataactaaaaaggttagaagagaaaaagttttcttctagccttcttttttacgcttatttttaaaaatcgccgttcatgattgaatcttttacaatcatataatcgaccttccgaatagcttcaaggtcacgaccacccgagtaagagatggatgattgtaagtcttcctgcatttcggttaaagtgtctttgatggagccacggtaaggaacgagcatctgctttccttcaacatttcgataagcacctttttgaacctcagatgcagaaccccaatattgtttgtattgttttccatcaatgttgatgacatgtcctggtgattcgaggtgaccggcaagcattgagccaatcatcaccattgaagcgccaaaacggacagacttagcaatgtccccattatgtctaataccgccgtcagcgatgattggtttccgcgcggctttagcacaccaacgaatagcggataattgccaaccgccagtaccgaaaccagtctttagcttagtgatgcaggctttaccgggaccaaccccaaccttagtagcatccgccccagcattttcaaggtcgcgaacagcttcgggagttgcaacgttccccgcggttacaaaagtgtcgggaagtttttctttgatgtattggatcattttgatcacaaaatcagaatgaccatgggcaacatcaattgtaatatactctggatttaattgttcggattttagttgatcaataaaattatactcatcatccttaatcccgaccgaaatcgaagcaaataatcctttttcgtgcatcattttaacgaaagctgctcgtgtctctggattaaagcggtgcatcacgtaataatagtcattttgggcaagccaaattgctaaatcttcatcgatgacgctctccatatttgcaggtacaacagggatcttgaatgtgtgagggccaaacttgacgcttgtatctgcatccttacggcttttgatcacacatttatttgggaccaactgaatatcatcataatcgaatgttttcattagggcagctcctttttaaaaatttaccgtaattattatgcgctaaaatatatgaagcgtcaatgaaaatagcgtacatttgctgagtgatatcaaaaaatagttcgataagctgttgacgacaaggaattaatccggtagaatagcgaagtaaaaacgttaattttagaaaatataactatgaggtgaaaataaatgtcatcagttgttattgttggtagtcaatggggcgatgaaggaaagggtaagatgaccgattacctaagccaagaagcggacgttgttgttcgttcacaaggtggtaataatgcaggtcacacaattgcatttgatggtaagaagtttgccctccgtctagtgccatctgggatttttgctaaagacaagttagcggtgattggtaatggagtggttattaatccacctgcattattaaaggaattgcattatcttcaagacaacgggatcgacatttcaggtttacggatttctagtcgttcacacatcaccttcccataccatattcttcttgataaatgtcaagaagaggcaaagggtgatcacaaggtgggaacgaccaagaatgggatcggtcctacctacatggataaggtttctcgtgttggtatccggatgtgtgacttgcttgaaaaagatacctttaaggaaaaacttgaacgtaacctcgctgaaaagaacgaattattcactaagttataccatgttgacccaattagctttgacgatatttttgaaagttactacgaatatggtcaagaattaaagcaatacgttactgatacagctcaaattgtcaatgatgcccttgatcaagataagaaggtcctctttgaaggggcacaaggggttatgcttgatgttgaccaaggaacctatccatatgttactgcctctaacccaatcgcggggggagtatgtactggtgttggcgttggccctaataagatcgaaacagttgttggaatttgcaaggcttactctacgcgtgttggtgctggtccattcccaactgaattaactgatgagattggtgatcagattcgtgaaacaggtcatgaatacggaactgttactggtcgaccacggcgcgttggttggtttgatagtgttgcaatgcgtcacgcacgacgggtttccggaattagctgccttagtcttaacttgcttgatgtcttgactggtttgaagaccgttaagatttgtacctcatacaaacttgatggtaagcaaattgattactacccagctagtttgaaggaacttgagcgttgtgaaccagtttatgaagaacttccgggatgggacgaagatattactggtgcgaagaagtttgaagacttaccaatcaatgctcaaaattatttgaagcgggtaagtgaattgtcagaatcaccacttgcaactgtttctgttggtgctgaccggattcaaacgattattgttaaagacccttgggaattcgcacataaataaaatagatgaaagcttctaatgtttgaataatctttaagcattgggggctttttattttccttgattcctctatggtataatcgaggcaaataaacgttataggaggcaagatgatgacacagccaacactaacagtagaaaaacattatttaaattggccacttaaccgtcctttaaatcaagctgacataatgcacgagttgggtgtgcatgcatccgatgaaaagggccaagatttaacgagtaaggtgatgatgaacctaactcaagtagatgttaacaaagcaggagaataccctgtgatgttaagtgtaatggataataacgggcaaagtactcaggtaagtatcaccttaaatattcaaccgatgcggacacagaatgcaactcaggaaactgcaacgcctcaaaaatcaagacggggatggttatgggttattatcgcaattgttgttatcttatgtgcatggtgggcaattagttctcataaccggcaagcagccaaccaagcggccactgatagccagcaaagtagtcaaataagcaataattcaagcagtatcagcgatttaacaaaagataatcaacgtctcgctaaccaagtggcagaacttaaaggagcaactcaacaatatcaaaaggaccatgaccaacaagcactagaaagtcgccttgataagattcaaagtcaaattcaagatttgcaaaatcaagttcaaagtaacaacgtgaagcaagatttaaaccaagttaacgaaacggttaatgaagtacgggaaaacccagcgaatgggacgaaaattgttaacaacctaaagaataagggtgattttcaagaaatctggggaaatattagccaagaagtgcagaagtggctagatgagtttgccaattagtgagtttgacagcgacaagctagacccttaaaatggtaataataattagcgagctttcccgttaaattgttagggaaagactcaagtaaatgctggatccttccttaaattagcggagggtcttattcttttgaaagattttaaattaattaaggaagtgacatgatggctcatgagatcttagacggttcaagtatgcaacgtgcattgacccggattacttatgagattatcgaacaaaataagggtgtcgataacttagtatttgttggaattaagacgcggggggtatatttagcaaagcgcctcgccaagcgactaaatcagttggaaaatgtagaaattcctgtggcaccacttgacgtctcactttaccgtgatgaccgtcatgtaccagatcatactcaagaaccaaccgtaaaaactgatcaattagatattgatattactaacaaacatgttattttagttgatgatgtgctcttcactggacggacagttcgggcggccttagatgctttaatggatatgggtcggccaacccgaatttcattagcggtccttgttgatcggggacaccgtgaattaccaattcgaccagattttgttggaaagaatattccaactgcaatgaatgagactgttcatgtagccgttgaagaatatgatggccatgaagatgtaacaatcgagcataactaaaaggggaacgaggcaaaagctcccatataacaataggcctccatcgttcggttttaccgagcggtggaggccattaatgtactgcgcttgttactgttacttattatggaattcccttttatcttatcttacgccaccaatccaccgttgaatgttcattaaatacccgggtaccaaattttttttgaaaccatcggacttgtttgggagtaaatccccggaatactaatggtaattttttccaatgagaataaagggcatagagaagaagaatgtattgttctttactaatctcatctattggaatctcactaaccatagtcattgaaatgcctgttcctagggcgggaaaagtatcaaggctaatcttatagattgggttattgctgatgttagtagtaaatactattaatgcttgtttctgtcgcggacgataaactttttcgatccgcttattaatcttatggacttggcgtttagttggattaagaattatattccgcatatgaaagcctctgatcgaacatctgtttagggaatagtatatcatagcagtaaatgggatcaagtcaaccaccatcgactaaagtcgatggcttgtgagcagacacccctatattgagtatctgaaccacaatttgcatagatacggatggtttatccaaacaaccgtagttgtttggatagtgactatctaattaccaatgccttttacattcccaggttgccataggaatgagtctagcctttgggctaggatttttgttgtttctggaatcctttttccagaatattcaatgctgcattgtgatcacgaatatgatgagtatggcattgcggacacgtccatttacgatctgccagtgttagctttttagtcccaccactacccataacaaaaccacagtcatgacaggtttgggtcgtatttttaggactgaccgtaatgaattgacgcccatagagatccgccttgtaagccaacatgttcaagaaagaccgccagccaacgtcagcaatgctcattgccaaagcatgattcttgagcatgttcttactacgcaactcctcagctactactaaatcgtggttcttgattagtgcagtagagatttgttggagaaaattatgtctttggttcattactttgacatggagtttggcaactaacaagcgttgtttttggtaatttttactatcacgtaaagaacgatgttcttttttgatacgtcgttgccgtctagataaaatacgctgttctttggctaatttgcctttaatagtgcgataatatcttggattaggaactgtgttaccttcactatcggttaagaaattatcagtattaagatcaattccaatatgttcgtgattagctttggacactttaacaaaagattcatcagaagctagttgcattgatagaaagaagtgatctgctggatctttagtcaacgtcacagtaccaattctagtctcacacattctcttcaaaagacgtgcttgagaaccggcaacccgtaactgtcctattttagggactttgacatggctattatctagaaaacagactgtaccgttagttagcaacgcagtcttttgccctgggtattgacaattggtttgataacgccagcgataactctttcgatgaaacttaggaacaccagcggtgtgaaccttccgaaaagagttccaagcttttcgatagttctgaatggcattagctttcgtcaaactgtcaattcgtttatcttctaaaaattgatagtgattcgacatttgtttagcgttttggcgcatagttagttgcttaatacgatcttgtaccgtatcaattggtagtttgactcggcttaattgccaaagttctttaccaattgcgaccatttcgttgtaaataaaacgactagcatcactattaaccttaattatttgtttctgttggtcactaggatagcaacgcattttcaatccataatggtattccaattgtgccattgacttcattttatttcacctcctttattgatataatataatcatatcatcagacaatgactataacaattgaggtgttattaatggcaaaagaaaagatccaagacgctatttatacccgtcgttatgtctataatttccattaccatttaatctgggtaactaagtatcgccaccaggctttttcaactaaggaactggtagacgaaatgaaagacatattgcgaatggttgcaaaagataacgaaattgtaatcgaaaagatggaagtaatgccagatcatgttcatgtactgatcagttttccacctagcaaggcgccaaccagcgctatcaaagcactaaaggggcgtagtgcatttatctttctcaaacgacatccagaaattcgacaatcacaatattggggtggtcatttatggtcgcctagttactatatgagcacgttaggtaatatgagtaaagatgtagtggaaaactatatcaacaatcaaaaatacaatgcactccaaaagaaaaaacgtccaaatggacgttgagtgagcctatccatcccatgactaaagtcacgggatttccggctaaatatgattaaaaaacgttatttacttattttttataaacatttatcataaatcttatgaaaattagggaaggagaaaaatgatgacaaaaccgattattggaatatcaggctcacggattattgatcaacaaggaccattccccggttatcgccggagctatgtaaatgaagattatgttaatgcagtgattcaaaatggtggaattccttatattattccatttaatgaagatccagaagtgacaattgcacaagttgcaaccgttaacgggcttattttgtctggtggccatgatatcgatccacgtctatatggcgaggaatcattgcctcagattggcgagatttggccacaacgggatgcgtttgacctcttattgcttaaagaagcggaaaaacgccataagccagttctaggaatttgccgaggagcacagttgctcaatgtcgctcatggtggttcgctttatcaggatattagttaccgtgacgaaccaacacttaagcatagtcagggacacactactaaccttgaaacccagacaatcatccttgcttctgacagttaccttgcaagcttatttggtgaagagcagctgagcgttaattctttccaccaccaattaattaaaacagtggggaaagatctttatccagttgccaaagcaaaggatggagtaattgaagcaattgaaaatggggatgggtcagtgcttggcgttcaatggcatccagaaatgcttcattctagtgatcagcaaatgaataaattatttagtgatttaataactaaatcaatgaaagaaggttaacaagcatgacaaaaactaaattaggtttttggtcaatcgtattattagcgatcaattcaatcattgggtcggggattttcctgacaccgggctcggttgtttcaatggttggaactaaggcgccacttgcttacttttttgcggcaatttttgcttcaatcttagccatcacgtttgcggcggcagcaaaatatgtaaataaaagcggggcggcctattcttatgcaaaggctgcatatggtgaaaatatgggcttttacatgggagtggtgcgattcttctcagcatctgttgcgtggggagtaatggctgttggggttatccggactaccttttcaatttttggctggaatcaatcgtttggcaatatcaccttaggatttgtggtgttaatgctgattatcatggtaattaatatgatgggaagacggatttttacaatcatcaatgacctatcgacagtcgggaaattaggagctttggcattaattattattgctggagttattatccttcttaagactggtgaaaatcattttaacgaacttaatcatttaactgatagtacgggaaagtccttgattcctgcgtttacaacgtctggattcgttatggccgttatttcagcattctatgcttttactggatttgaagcggtagcaactggttctgaagatatgaaagatccagaaaaaaaccttccacgagctattcctcttgctatcctagtcattgcaattgtctatatttgtacgattgcagtagcgatgatggttaatcctgctgcaatggtaacaacgaagcaggtagttgcccttgttgcaatttttcataataaagttttgcaagatgtgattttagttggtgccattatttcaatgtttggaattaacgtggcatcatccttccatactccccgagttttggaagcgatggctaacgaaaatcaagtcccccaatttattgcgcgacggacaaaacggaactttccgctagtatcctttatcattactttagtattagcggttggaatcccaatggcttttcaatataacttgccaacaatcattgtgattagtgcaacggtgcgtttttttgaatttattgttattccacttggggtgatccgattttatcggggaacaaatcgtgagaaaattttaccagctcataaaaatttctttactgatgtaattttgccaatcctttccgttgtaattacactattcttattaatgcggtatgattggattagtgagtttagtattaatcgtgcaggacatctaatgccaaattggtttgcaatttttggaatggtttttggatttgtgattttaccgttaatcttattctggttaacgcgtcgtgagcgagctgaaaatgatgaacgagtaaaatagaagaatagaaaaaacgctcaatgactgcacaaatcattgaacgtattactttagggaataatagtagccgatatcgcacattatctgctactagtaaaatgttaagtctaattgaggcgaataactaaaaacaattattggcaccaccctagaagaaagaacaatttaactttgggagtttattaggatttttgtccttattaaaatgagaaaaagttaaggacactttagaagtcattaagtaataaaattgatctcttcacgaattgcttttgatgttaaagcttcaattcgttgatattttaccaagtaatttatcaatagttaatagttttacgagattatgcactcactgtgtacaaggaacaccaagaatatactttgttctaataagagtgttattttactatatttttactaattgtttatactaagataatatagtttggagtttatataggagaaaaaaagatggatattcgtaaaattaatacgttaaatagaattaaggaaggatttattactgttttagatactaaaaaattatcagaatgtactactaatgatattgtagatagcgctgaaattagtaaaaaactttctacaactattaccaaaataaacaagatcttctccatgaaattgaaaatgatctattgggaggtctaaaagaagctctcgtaattgatcgggaggagctaaaagatgtcaagcatttaccaagtgcagacgaaattaaggaattagcagaagtggcatttaatcatacgttggctttttgtaatgaaaataagcatgcgttgtcaaatttgctttcctcaaatggagatatgcagttttatcaaatgattattgaagtagcaaataatgaatttgatgcgcgagttccatatttgtttggggatataaatattaaagaagctaatgtaaaatcgtcattgccattctcatttattaaaaccctctatatcaatacaagtgttaatttgttaatgctttggggtgccgcaccagactctttaagcattaatgaaattaagtcaattgcaggcttgattcaaacaaaatcaccagttgaattgattcaaatttataaatcatatttaaactagaaaatgaggagccgaaaattttttctcggtctcctcatttttattatcaaaaattctttttaaattaattgcccttccaataacgtgcccgggtaagcagttcccgtgaacgctggtcagctggtcgataacccttagtaaataggtgtcggaagtacatcatattatagaaaaagccaaagaaaacagaaggccatgggaattggagcagggcattaagtccaaagaaaagggctaccaaagcataatcgagggttaatacaatcattaaaatgaaattatagtaatccgcgcgaaaaagagctggcagtggcccgaaccaaagagttgtccaagaaaagccgactttggcgattcggatatccccctggtcattaacgattttagcgtaatttggtgggagggggagattgtttaagttaaacggattttggttatcattattgttattaccaaatgggttttgcatatctcgtccacttctttctataaataataatattaacacattgagtgagggataggaaacgtctctattaggctttcaaggaatgttaacaattatatggtaaactcaaagcgataaccatgaaaggggaaatcaaggatgctttttttcctaaacgataatattcaacgaaacaaatcaggaattgagcatgcgcaaattaagcgtctgcatctgtttgaaaaatatcatcaaccagctaagattgttacccggcaatattcgaatgaattacacttggtaacagcagaagcagggattgatgatcgtaactttattaacttgtttgattattttcaagaggcttgtgaggtcccgcaaaagaatattcggattaaagatattccggttaacccccattgggagcgcaaagctgatgggattaattataattattatcaaaatggcaaacgtattctctatattcgtcggcgcagtgatactgatcggcgggtaattaatattcaatattttgatcattatggaaagcttctcaaagttagttggtttgacagccgcggttttatctcggtcgaacaactttatgactgggatggaaaaatggcaacggaaaactattaccgtccagatggaaccttagcaatccagttagcccaccagcaggataagcggggaaatgaaattaaaacttatcatctctttaattatcatggtcatgactaccagtttagtggattcgaccagttaacccggttcttccttgatgagctggttgctgataaacaaatctgtggtgaaggtccgattggctttatcgttgaccgggtttatgaattaggctgggcagttctgcacatgaaacatcatgtttttcgggttctccaattgcataatgaccatgtcaataatcctgatgatatgcttcattctccccttaattataactatgattggggacttaagcacctccaagattgggatggggtcattgccttaactccgcaacaacaagaagatcttcaagaccggtttggcaagtttggtgtaaagatctaccggattcctggtccgattgttccggcggcagttattgataagcgccatgttccatttaaaaaacgaacgaagaaacaagttgtcatggtcgcccgcttgtctcctgaaaaacagcaagatcacctattaaaagcatggccacaagtactagcagcagttccagacgccaaacttgatttttggggttatgccaatgatgactttgacaagacactcaataaaattgtaaaagaggaagggattaatagttctgtgaccttccatgggtatacagatgacgtcaattcggtttacgaagatgcgcaattacttattttgccaagtcgagctgaagggttaccactatctctagttgaggcccaatcccatggtttgccgattattgctaatgacataaaatatggtccttcagatgtcgttattgatcgacaggatggattgctgaccaagaacggtgatattgatggactggctcaagcgatcattcgcttattgcaaaatcaagagcagttagcgcagatgagtgaaaatgcgtatgctgatagtgagcgttattctgaaccaaacgtgatgaagctatggaatgaactagttaatgacatgaaggaaaagggagaagagtaaagtgtacttttttgtaaatcaatacttattaagtagcaattccagtgttgaacacgctgaattaaaacgactagccctatttaaaaagcatgggaggaaagctaaattggtgacccgtgactttgacctcgttcttcatgatacaatcaaaaaatttggcttaactaacgaccagattgttaatatgtatgatttttttgcaaatacgactgattaccaaggcgaaaagctccatactgaggatttgcctttaccaattgactatcaagtaggaactggaaataactatcgcgaagtaaaagacggtgaccgactcgtttgcgaagttcactttgcggctggaacgattgggcaagttaaccatgttgattactttgacattgctggtaacatgactcttcgccaacaatatgatattcgtggctttaaggcagctgacgaattctttggtgaagatggacaagaatattacgcgcgttattatcgcccagatggagaaacgtatcttgaacggtattttgtaaaatcggttgaaaatacccccattaattcgctgaatgtcttacgtaattatcaggggcaagatcgcttttttgattctttagaagacctctttatcttctttttagatgaattgaataaggcgaatggcgagaacaatgtgtttattgctgaccgaccagctgttgcgattaaaccggttcaatcaatgatgacaaaagcaaagaaatttttgtggcttccgatgaaccagattaacgatggtcagaacttaataaatggtcccttaaatccgatgttgcaaggtcctgttactacggatgcggacaagtgggatggtgtaatcgtcatgactgctaaacaagcggagattctccagcaacaaattcacaatactgtgccaatctatgtaattaatgggagccccgttcttgctaactatgcacggattaatgaagctgatcggacaccgggtcaattgatttacgttggaagattggcagaagataagcaaactagtcaactaatcaatatgtttgcgcagattcatcagcaagtacctgaaagtaagctaactttctatgggtatggcactggtgaagatatggataactataaaaaacaggttaaaagccttggattagacgaggcaattgagtttgccggttaccaaatatcattagatgaggcatatgatcaagctcaattatttgttgatgcaagtcgaatcgatgcacagccattagcgatgggcgaggccttaaaccatggggtaccagtggtttcttatgattacctttatggaccacgtgaaatggtaacttcaggtaaaaatggcgagatcattcctttgaataaccagggacagttcattcaaaccgttgtcaaattattacaagaccaagataaactgcaaagcttgagtactggtgcctatgacaatctagatgaattggcagaagaaaaaacttggaagcaatggcaacaactatcagctatttagtcaaaattggttataatatattcagaagacgaaaagcagaaaataatcaaatgtttttgaagcctttggtcgttatcctttgataatctaaagacggaaaatgaggacggaatgatggataattatcaagcaatgaatttttactatggacttcttaatttgcgtgccggtttttttaaggctgacttatgcgaaatactaatggcgatcgcacagagcgtacctgataaaaatcgacaatcagcaacggcataccatactgtagaagagaatttaagtcaagaccgtgaacaattgaagcatgatcaagttgaatttggatcattttatgaagatggtcatattttacataatgtcaaaattaatacccaatcagactttttcctcgatccgacccgggaagataccgtcaagtggcatgttagtttcacggttgctaaagatgtccgaccagccgatcaatttactattcagctatcatcaaatttgatggttgcgcctaatggtcatcctgaaaaaccagttcctgactttagtgatcaagatggggttgttattgcgatgggggcctatgaccgtgataagcacgaacttgtctatacttttaccaattacgtaaccgagcatcgccaaataattggtgaattagagggagaattagcaattgatccactcacaactccagagaacgaatttggcttggaatgttttataagtgttgatgatcaccgaaaagactttacgattgatatcgactatccagatcttgctaacgacatgtttctcgggatttctagccggatgatgcattttgataaggatcagcagctctttgaggacattatctatgttaatccagcacaaaaagaccttaatcatgcctatattgtctttaacacgagtgacctagtagaagagttatctaatgccgtagtaaaaccgtcaacaatgcgggttgagatttatcgtaattcacggggattaaaattacctcaatcatatggggtaaaccttcagcgactgcgggatattactaatcgattcccggtagtggaaggcgatcaccttgtcgaggcaccttatacaatgtcctttgctgataacaagatgcggttgaattttggtgcagaccagactaatgattcctatattattagggtggttggccaatataatgatgagcttgatggaacagtacgattacgggctcgtttatttgggatggaccagcaaaatgtttatatgagtaattctacggctgcaacagctactggcacttcgatggtcgcaagtggtcatgctatttctaaggagaagttagcggaggagacagcggacacaacagaagacttgaagcaagaagaaccttttgaatcttcagcaattgaaggagtggcggaagatgttggtattccatctgcttctgatagtcaggaacagtttactagttctcaagcggaagaagaggaaatgccgatcgaagaaaaccaggaagatatcccgattaatgatgttgctgcagaagagcaagttgaacctcaagaagatttcccgcaaagtgcaatttcagttccagatgatgcagccgttgaagaagaatctgactcatcagcttatataatttcatttaattcaaatgatgaagaagaggcgactgctgctgaacaagaaggaaatcaggcggaagctcctacagtcagtgcagcagttggtggggatgaattatcaatctcctttgatatcactccgcaagcggcaccagcagagactaaagaagatctaacagaagaaactgaatcttcagatgggaaagaggagacaagcgcagcaccattaccaatgccaggacgacgaccaccccgccggcacagtcgttttcaaaatacaacacggtcgaatcattcgttgcgtcatttgcggagattctaatagaaaaaataaagtgtcaggagagattatcctggcattttatttttactaaaatgtaatcgtttacataaaatgcttgtaattaaaaatataggtgttaatatttaattaaagttaagtaaacgtttacattaatagttaaagtgaaaattatagtagttttatggagagaggttttattttatggaaaacaatcattggtggaataaatcggttgtttatcaaatttatcccaaaagttttcaggataccaatcatgatggtgtcggtgaccttcgtggaataattgatcgtcttgattacattaaaaaattaggcgttgatgtcatttggttgaaccccatttatgagtcgccacaagttgataatggttatgatattagcaactatgaagcaattaacccaactcttggcaacatggatgattttcaagaattgattgatggcatccatgaacgtggaatgaaattggtcatggacttagttgttaaccatacttctgaccaacatgactggtttaaggaatcacgaaagagcaaagacaatccatatcgtgattattatatttggcgtgatggtaagaatggtgaagagccaaataattggggatcgtatttctctggagctgcttggaaatatgatgatgaatccggccaatattaccttcatctttttgctccagaacaaccagatctaaattgggaaaatccgaaagttcggcactctgtttatgacatgatgaactggtgggctgcgaagggtgtcgatgggtttcggatggacgttattaacctaatttctaagccggatggattgccagatgctaacaagaacgaagatgagaaatacgccaatgttgagccattagtatcaaatggtcaccgcattcatgaattcttacaagaaatgaataagaatgttatgagtaagcataaaatggtgacagttggtgaaacaccgggcgctacaccggaagatgccgagaagtatgccagtcttgataataaggaattaaatatgattttccagtttgaacatatgggccttgatagtaatcctaatccagcccttggcaagtgggatgatcgcaagacgacccttaaagacttacgggcaaacttaacgaagtggcaagaaaaattgtatggcaaggcttggaactccctttattggaacaaccatgatcagccacgcgttgtatcacgttttggtaatgatcagacggaagattatcgagttaaatctgccaagatgttagcgactatgacccatatgatgcaaggaacgccatatatctatgaaggggaagaaattggcatgactaacgcctatttcccaaagcttgaagattacgtcgaccttgaatcgattaatgcctaccaccaacttgttgatgaccaacatttacttgatggcaagacaatgatgaagtacattgcaattcattctcgggataatgcacggacaccaatgcaatgggatgatagcgaatatgcaggattttccgaccataccccatgggaaaaggttaatccaaattacaagcagattaatgtcaaagatgcattagctgataagaattcaattttctattactatcaaaaattgattgaactacgacactcaatgcaggtaattactaatggaaagtatgcgttagttcctggtaatgaagatgatgaacagatctttgcatatacacggcaagatgataacactactttgttggtaatcttgaactatactgatgagactgttaaccgccattataatgtgccagctgatgcgaagttactaattagtaattatgaggatgatcaaaatgatactatccggccatacgaagctaaggtttatcaatactagagtggggatgaataatcatggataaatcactttcgaattcgaaacaaaaagttgaaacgaagcaggttgatctggatacaggaatgccagatttaccaaagaaagagctatttgcgattacatttgcttttttgggaataaacatggctttctcactgcagagttctcagatgagtcggatttgtcaaacgattggggcaaatcctaacaaccttggcttcttcttcatttttccaccattgatgggaatgattgtgcaaccgattatggggaagatgtcagatcggatgtggaatcgctttggtcgccggttaccatatctactgtttgggacaccaattgcggcattagttttgattatgttaccattctctggttcccttggtttcggctatggttcaatggctgcgatgatttatgctgcgacggcggtatgtttgatggacttatttagtaatatttgcatgcagccatcacggatgattgttggtgacatggttaataacaagcagaagaactttgcttggtcatggcaacaggtcttttctaatggtgggggaattttagcaacgatcttgccatttatctttacgatgttcgggatgtccaatactgctaaacgaggagttgtgccaaacaccgttatctggtcatacctttgtgcagcggcggttctcctgtttactggattatggacggtctttaatgttaaggaatatgatccggaaacatatgcaaaataccaccacattgatcccgaagaacaaaataaatcagtcagcctttggaaattgattaagacggcaccgcgcgctttctgggaaatcaacttggttcaattgtttagctggtttgcgatcatgtacgtttggacatacacgactggaacctgtgctcgtaatatttggcatacgtctgatgttacttctgctggttatcaagctgccggtaactggtatgggattttaactgctgtttatagtattgctggtattgtttggggattaatttatgcccatgccaaggctggctcacggaagaagtggtacacatttggaatgatcgtcggtggtttagggttagtctggatgacctttgtaacaactaagactacttcaatcattgcaatgatcatgtttgggattggtaacttcagtatcaacacgattccatttaccctccttacttcatctttgaacgggaaaaatgaaggtgcctacctcggactcttcaacgttggaatctgtgtaccgcaaattgttgcatcgttatgtagcttcttcctcttcccacttgttggtcacaatcaaccaatgatgcttttgcttggtggcatctcccttcttattggggctttagctgtccaagcaattcatgaaggggtaacggttaaagaagcatagcactaattaaatctctccttaaatatagaatagttaaaaagcgggactggaaatctatccggtctcgcttttaatgattatttgattgttattgcttccaaagattgatcttctttaacgcgcagcaacgcattgactgtatcaagtgaggtcatcaatggtacgttttgcgcgattgtactttggcggatctgaaagccaagtgaatcttgttcataatcatggcgcatggtgttgataacaaggtcgatctgcccggcttttaggaggcagttgagttcatcgatattggatatttcttgatgaatgtgaattccgttatctttaaagtgcgatgctgtttgcggggtagtgaaaacttggtagccaatctgagcaaaccgttttgctagtgggagaacttctttttcatccccgttttcaatcgtaaagagaattttaccatcgttagggacttgaatatgtgcgccagaaaaggctttatgaagtgctttttcataggtggtatctgtccccatcacttcgcctgtcgatttcatttctggactgaggtaagaatcaacgttcgctaacttgttaaaactaaagacaggagctttaacatgaatggtttgtggttctggataaagaccgttagtaaagccttgatcagcaagggactggccaaggataactctggtagcgacttgggccatttcgattcccgtaatcttgctgaggaatggcactgttcgactagctcgcggattaacttcaaggatgtacacctcatgattatgaacaataaattggatgttcatgatgccgatacatttaagcgcaactgctaatttttcggtagcagtaacgatttgtcgtttaatgtcatcattaaaatgttgtgggggataaactgccattgaatctcctgagtgaacgcccgcatgttcaatatgttccattattccagggataaggacgtcctttccatcgcaaattgcgtctacttcacattcccgtccttcaaggtaggcatcgattaaaatagggtgatcagcagtaatggaggcgttttgttgaaggtattgttgcagttcttcttgattataaacagtctccatggccttaccaccgagaacataacttggacgaacaagaacgggatagccgattttttcagccgctttgataacggcagagtgagtagttgcggttaaaccgattggctgcttaagatttagatcagtgataacttgatcgaatacttctcgatcttcagcggcatcaagatcgtcaacggttgttccaagaatattaaccccatttttagcaagaccttctgctaaattaatcgctgtttgtccaccaaattgcacgatcacgcctactggttgttcgagatcaatcacgtttaggacatcttcaagcgtgaggggctcgaaatagagtttatctgaaaccgagaaatctgtcgaaacagtttctggattcgaattgatgacaattgcttcatagccagcccgttgaattgccttaacgctatgaacggtcgcatagtcaaactcaactccttgaccgatccggattggccctgagccaaggacaaggatagatggcttctttgtccgttggctttcattttcatggtcatatgcgctgtagaaataaggggttgaagaagcaaattcagcagcacaggtatcgatcatcttatatacggggagaacttcattttgttttcggaatttccgaacttcttgtgaggaagtatgccaaaggcgggcaattgttgcatcgctaaagccgtattttttgctggttatcagtgtttccacatcaaatggcttggtactaagatcgtcttcaagttccaccaagtgtttgacgatatcgaggaaataaggggaaatcttagttaagtcatgagtttgctgaagggagtacccacgccgaaatgtttctgctaaataaaataaccgatcatcttggggataacgtaacttcttttcaagcatatctgttggcgcatgatgagcttctgctgaaaagaggtctttttcatcaatttcaagtgagcggacagccttatggagagcttcctcagctgtccgaccaattgccattacttctcccgtggctttcatctggctgcccaggtgtcgatcagcctgagtaaacttatcaaacggccagcggggaattttgcagacaacatagtcaagtgccggttcaaattcagcaaaagtcgtcttggtaacgggattcttaatttcatcgagggtaaggccaaccgcaattttagcagccattttagcgattggataacccgttgccttcgaagcaagagcagacgaacgggaaacccgtggattaacttcgataacgttatactggaaactttgcggatcaagggccagttggacgttacatcccccttcgattttgagggcacggatcagcttgagcgcgcaatcacggagcatctggtattcgcgatcactaagggtctgattaggggcaaatacgatggagtcaccggtatgaattcccactgggtcaaagttttccatacaacaaacgaccattacattgtcagctgcatcccgcattacttcaaactcgatttccttataaccagcgattgacttttcaattaaacattgggtgacgggggataattccaagccattcttggcaacggtacgcatttctgcatcattatggcagatcccaccgcctgtaccacccatggtaaaggctggacggacgattactggatatccacattggtgtgcgaattcgactgcttcatcaacagtattaactgtctgcgaggcgggaacaggttcaccaagttcattcattaattccttaaatttttcgcggtcttctgcttcatcaatcgaatccagcttagttccaagaagttcaattcctaattcgtcaaggagaccagtttcagataaagagacagctaagttgaggccgatttgtccgccaagggttggtaaaattgcatcgggatattcttgacggataattcgagagagggattcaaccgttaatggttcgatgtagacatgatcagcaatttccttatcagtcatgattgttgctggattagaattaacaaggatggtttcgtatccttcttcgcggagggcaagacaagcctgcgtgccagaataatcaaattcagctgcttggccaataataataggaccagacccgatgacaagaattttatgaatatcagttcgtttaggcataggtgaggacctccttattactgtcaattaatgccatgaatttatcaaaaagctgttcagcatcgtggggtcctggcgcagcgtctggatggaactgaacggaaaatgcaggatactttgaatgctggagtccttcaaccgtgccatcgttcacttcaaggtgggtgatttggaggtcagtatcatcaatggaggatggatcaaccgcaaagccatgattttgggaggtgaatgcgatctttcctgtttggagattacggacgggatgattaaaaccgcggtgaccaaatttcatcttataagttttggcaccattagctagggcaaagatttgatggcccatgcaaatgccgaaaatgggaagatgtttttctaattccgcgacggttgcagctgcgtctgtcatttcaagcggatcaccaggcccgttggaaaggaggataccgtctggattgaacgccattatttcactgatcgaggtgttataaggaaggacaattgcattgcagtttcttttatttaattcacggagaatgctatttttcatcccgaagtcaagaacaacaacagttcgcttagttcccggattagcgtaggattccttagtagatactttgctaataatgttctgggttggcgaagtttgttttaactgttcaatcttatctttaatatcggtaatattatcggtcataattccgcgcaatgttccatattgacgaagcttacggactagttcacgtgtatcaattccttggaggccaggaatgtggtgctttgctaagaaattagggagtgagtcggtcatgcgccagttgctgggaacacgagcaacatgatgacaaattacgcccttgatttgaggatacaatgtttcgttatcttcactattaatcccatagttgccaatgaggggattggtaaagactaaaatctgattggcaaatgattgatcggtaattgcttcttgatagccgaccatccctgttgtgaagacaacctcaccaagagttgccttggtagcgccaaaaccctcgccggtatagacagtaccatcttctagaattaaatatcgtttcatgagtttcatcctttcttgcaaaacccttccactgatcacataaactagttgcacgttgtaaaaaagtttaataaaaaacgcttaaaccattggtaatgggcttaagcgtatacgaaaaattgaatatatatgtatgattcaatgttagtaatacaacgctgcccttgttagcctcacgggaccaaattaaaggataatgattgatactaaactactgtaattttatgcttttgtcaagttattaatgaatttttatgcaaaaaatatgtttattataaacaaaaaactgcataaagacttttaggtattataacaaatcttatttaaaataaaagtagagtctgcaaattttgtctgcaaactctactttatttagaataattaggcttggtaagtttccttgataaagagaactgaaattgcacctaagagggcagaaataccggtaacaagcatcatgttgacttgggaactaccaagtaatgggaagagaccaaaactaagtagtgaggcaaccatttgtggtacacagattgaaccattaaataggccaaggtaagtacccatgtgtttaccagataaggcatttgtaaccattgttaatgggtaagtgttcattgaagcccaagcaattccgatcaaaacgaaggagaagataagggcgttttgtgaatggataaagaagattgatgtgtacccaatagccccgagcaaaagactgaaagcatagccagctttgtggtggttattaggaactttagccaaaacatatgaccacacaactgccgcaattgattgaaccgcagtcataacaccgtaccagttaccagcagcttggtaggcagcagaagaagcattcgtggttaaccaaacattcttagcgatggccccaaccgcataagttgaaaggtattggaaagagaaccagcagaagaattgaactaatgcgacattccaaaatacccgtggagcatgctttaagagggtaaaccagtttccgccttttttattatcttcctctgaaatgccatggtaacgagcataagttgcgggatcatattcgtgaacccggaagatagtaaagagacaggtgatgactaaaataacagcgccaacgtagaacgaaattacaactgattggggaacgacaccctttttagcagtgtttgatacaccccaccatgtcaaaaggaatgggaaaatggctgctaaaacggcaccagtattacaaattaaactttggatcccgtatgcataactcttttggtcatcattaaccatatcaccaaccatcatcttgaatggctgcattgccatatttgatgaaagatcaaggaaggcaacggtaatagccccaaaccagagggctgctaacgaaccgtatccaaagccgaaacttcctgaattaggcagtaaaatcataacgatgacggcaatgaccatcccaattaacaagtagggaagacgccgaccaccaagcttgggcgcccatgttcggtcagagtaataaccaatgattggctgcacgatcaatcctgcaagtggtggaagtaagaagaaccatcccaaattattaggattagcaccaattgtttggaaaatccggctcatttgcgaaccttgtaacgtaaaggcgatttgaaccccaaggaaaccaaagttaatcatccagatggtactctttggtaagattggtaatccagtcgtcgaagtttcttggtcttggttaagtacaacagactcatcttgactcatgaaaaacaactcctaacgaaaaaatgtataaaataattgcaattcgagctggtgtaagctcttacacgattaatataacaaacttattctttttgtgcaaccgcttgcaaaaaagaatgataaaaagtcgcggtttgtttcaattaaaatcgcgactttctaatattctaatgatttttcgcttaggagtcttacgctatttcgcggtgtgatatggactgggataaattgtgagtcatcatcgttcaataggctcctaactgcaatgagtcccatttgataaaagtcctgggttacgcttgtaatagttggaatggtgatatcacagagaaaagtcccatcgatactaataaatgataggtctttcggaatatcaaggcctagtaaatgagcctctctgatcatgcccacggccaccatatcactagctgtgatgatcgcgtcaagatccttattcattagtgttttgagcatgttttgttgaggaccaaaactgtaatcgccatattcaacccattccatatgaggaatcaagccgtgttcagtcagtgaccgttggtagccatgaagtcgctgctttccagttgaagaacgatcaatgccggctaatccaattcgggagtgtccgcgttcaattaaatagttagcggctgaataaccaatttcctcgttatttgaacttgtaaatttaaatccagtataccggggatcatcttcatcatagaccgatactaaccggcaaggagtattactttctcgtagggtgcgagcggcttgttcatcgagggaagttgcgactagcagaataccggcaacgtgtcgttcgagggcaacgctaattgcttgattaagcagtcgggcatcatggttcccggcgtaaagaataaacatttggtaaccagctttatctgtttctgcttgaatagcagcgatgatatcatttgaaaaattcgtttgagtattatttaagatgacggcaattaacatactgctgttggcagctaattcagccgctgcgaggtttttcttgtatcctagttctttagcgattgcttcaatcttagccgcagtttcgggacggtaggatttcgcttttttggataaaacacgagaaacggtggccgttgaaacatgggcccgttgagcaatatctttaattgttggcttcataatcgggcttcctttattattttccttattaaatctattataagaaaataacagctctttgtaaacgttttcaatcagggcttaatcattatttaaaacaaaaataggccgaaagaaaaattcttccagcctacatagctattctttatttccgtttcgtaatgataatttcacgactgcctcacagcgtgctgtttggggcatcatgtcaattggttgaatgtagtcaacgtgatagacactagttaaccgccgtaagttgcgggcgagagaagccatcccacatgagacgtaggcaaactttcgcggcttaacttttaagatttgcttgattaattgatcatctaacccggttcgcggaggatcaacaacaagggcatcaaagttgagtccttctttttgccagcggggaagaacttcttctgctttgccgacttcatatttagcgttagtgatattatttagcttggcattttcgttcgcatcagccactgcttcggggatgatttccattccgcgaacagctttcacccgcgatgcaagtgaaagaccgattgtcccgatcccggcatatgcatcaattaaggtatcatcttggtctagttcaagggccttagaagcttcttcgtacaatacctctgtttgttcaggatttagttgtaagaatgaacgtgctgagagtttaaaatcaagccccatcaagctttcaaggattgaatcttttccagcgaggtggatcattttatcaccccaaactaagggtgtatcacctgggttaacgttttgcataactgaaacaactgctggtagttctttttcaatgcgttcaagcaattcgcgtttgtgaggaagtttagcagaattagtaatgaaggttaattggacttccccagttgaccatgattcccgaacggctaaggtcttgacgataccgctattgtgcttttcatcataaaccgggatttgcaagtcttcgatcatctttgtaacggcgcgaactgtctccattgtacggggcatttgaacagcacaagtctccatatcaacaagggtatgactgtttggttggtaaagaccggctgccactttgccgttgaccatccgcacctggaattgggccttgttacggtaaccgtattcttcaggggctgcaatagttgggcgaacatcgtaattacggtagccgtatggttgaaacttttcgagactatcgatgattacttgccgtttaaactttaattgttgttggtaagcgaggttttcaagttcaaaaccaccagcgatatcagcgtactcatctcgtggcgttacccgatcccgactctttttccggatccggtgaattttagcttcaaggtagcgcgggagaacgcgtgtaacttccgcgaccacgacttcatttggcagggcaccagggacgaaacataccttgtgcttatagtagccgattccgtgcccgttaacgccaaggcgacgaatcgtgagggggaatcgtttcccaacccatacatcaacatcttgttcatgttgtttagtttgtgtcatattatttctccgttctattaattcaatgtgttgactattttagcacatctctaaataccactggacaaatatgtcagagatgaaaaatcgcgtaattaattttcggaatgataacttagccaaacttatagtcaattattatggaaatagtcaattaagtgtgcatattactaataatatgttttttgaacgagtaaaatatagtagaataacaatgtgaaatgttgcataaataacttaaaggaagtgacacgtttgaaaattgctgcaattgccgggtcaaatgctaatcattcatacaaccggatgttattagaatttattgcccgtcattttagtgatgatgatattgatgtgattgatattcgtcaagtgccaatgtttaatgaaaattataagggaaagattcctgaggctgttgctgatattgatcgtcgtgtttcaagcgccgatgctgttatcattgccagcccagaatacaaccactctgttacctctgctttaaagtgtgtaattgaatggctttcctatgaagttcatccattagaaaataagccagtcatgatcatcggtgcttctacccatgaccaaggctcatcccgttctcaagttcaattacgagatattttgatctcaccaggtgttaatgcttatattttccaaaacgaagagttctttatgagtgatgccgctaatatcattgataaagatggtgacattactaacgaaacgactattcatttcttagaaaaatgtatgcgtgaattcaaacactacgccaaggcaatcaatcgtatggttgctgaaaagaaggaggcgaagaagtaatgaaaatccttgctttagttggaactaatgccaatttctcatataaccggattttgcttaaatacatgaaaaagcacttccgtcaaatggctgatattgaaattgctgaaattagccaattgccaccatttagcgttgatgcccctctttctgaacaaacagaggtatggaagttaaagcaaaaagttaaggctgcagacggagttatcttctcaactcctgaatatgaccatgggattccagcggccttaaagagtacagtagaatggctttcttacaagactgatgtattaaaacgcaagccagttatggttgtcggtgtatcttatggacgccaagcttctgcaagatctcaagttcaaatgcggcagattctggtttctcctgattgtgatgctaacctattaccaggaaatgaagttctgattggtaatgctagtcattccttctccaaagacggtcggttaattaatgccgaagcacgtgataaccttgaaaactgctttacccattttgtggaatacattcaaatctttgaaaatgcaaataaggagggactggatatgtccgttaaacaaccaacgatcagtgaagcttacattaatttccctactggtcggttgacattaaaagaagttcaacaaatcttcagtacaatcccatttgaaattgacttaattgacagtactgaccatttcgcatggttctctgacaagccaaatcgggaacacgttcggaatgtagcttctctcggggaaactgttcaagaatgtcatccaccgttggctgttccggctgttatgaagattattaacagtttccggaatggtgaaaaagacgttgttacccgtccattatggatgaatggtcaccgttcattgattcaatactacgctttacgtgatgttaatggtcattaccttggaaccatcgaatttactggtagtgtggaatacattcttaacctcttcgaaaatggtgcatggagtactgatggtaacactggtgcatctaagcatgagaatgctaatgacaacagtgaagaagctgacagcgttgatgcatcaactggtgcttcagaatcaagtgatgatgataacgccgacagtgttagtgaagtggttgcaaccccagcaccagcagcaaacgatgatactgatgcggacgctacaacaggcgtatcagatgcaggcagcgtagacgcaaatgatgatgaggcagatgcgacaacaggtgcatccgagaactaattatgaataatgaattgatggcgcaacggcatgtgatgactcatcacgctcttggaactcgcataaatttaacgatttttggtaacgaatatttttcgttgttaaagaaatcaatggacctaattgaccactatgaggatcaattaacggttaaccgtaatgaatcagaagtaatgtcggtaaatcatggtgcagggaaaaccccgaaaatggtatcgccaacgacttttgacctcattgaactggcagtgaaatatagtcgtgaaaactttggctttaacgctttgatcggcccgttagtaaaactatggaaaatcggttttgcgggagcacacgtgccaagtgatgctgagatcaaagagcggttaaagttgatcgacccttataaagtattgctgaaccgagacgcacggacggtatatttagaagagccggggatggaattagaccttggcgggattgcaaaaggctatattgcggaccgtattcgtgatctttggattgaagccggcgttcccgcgggaattatcgacttagggggaaatctcttatttgttggtaagtcgccacggcgggatgatgggcagtggatcatcggtgtgcaggatccgcaactgcatcgtggtgaaaatttggcaactgtccgtgagccggcttgttcggcagttacatctgggatttatgaacgatttttgatcaaaaatggtcgtcgttatcaccatttactagatcctcggactggatacccgttagagactgatttgagcagcgtgactgtttttactgatcaatcggtaatgggtgaaattgaggccaagcgactcttcttcaatggtgaaccaattacaggctggaaagcgcgtcctggtaaccgtggcgctatctttattcataatgatgaatcaatggtaaatgttggttttgaataaaatttaatttcatttaagcgtaggtaaacgaaatgtttacctacgcttttttgtgtgcgcccggcatgggtattagctaggcggtgagagtccgctatgggccgtagtagtcggaaccatgagctgaggacaagggtgtccactgtgaggttgaatctgaaggaagtctaaggcaaagtactgcaccgatgaacaagaagtagctataaggctggaactaactggataagactgcatgacaagttaaagtccaacactactcgaagttactttcagtaaagctaccggtgacatggtacgaaagttaatatccttacccggggagatctggcctacacgtttccgacaagaggaataagtttaatttccacagaaacaagcggtgcagtgatgtagcgttgagtaagccagaagtcagccgaggtcatagtagtctgagtaatcagatgaaggactgaacgacaataacttgtaacttatatcggaggtgtaatcaggtgcgacaatcgcagaaaacagaacaacaagctgaccgcttgtcgaggataggtttggaaaaccgaaagtacacaagggcgcgtagtaccgattatggtgaaggtaaaggtatgagtgtcactatccaagacttagtcttggaccgcaataaccttaatcaggcttatttgcgagttaagagaaataaaggggcagcaggcattgacgatatgacagtcaatgaccttctgccatatctcagagaaaataagacggaattgatcgctagtttgcgtgagggcaagtataaaccagcaccagtcaaacgggtagaaattccgaagcctaatggtggagtaagaaaactcggaataccaacagtggtggaccgaatggttcaacaagctgtggcccaaattcttacacctatctttgagcgtgttttctctgataatagttttggcttccgccctcaccgtggggctcacgacgctattgcaaaagtagtagatctttataatcaaggttatcgaagagttgtcgacttagacctaaaagcctattttgataatgttaatcatgacttgatgattaagtatcttcaacaatatattgatgacccatggacactaaggctcattcgtaagtttctaactagcggagtcttagaccatgggcttttcgctaagagtgaaaaaggaaccccacaaggagggccattgtcaccaatactggcgaatatctatctaaatgagttggataaagagttgactagacgtggtcaccactttgtgcgctatgcggatgattgtaacatttatgttaaaagtcaacgagccggagaacgagtaatgcgaagcattacccagtttcttgaaaagcgattgaaagttaaagtgaacccagataaaaccaaagtcggtagcccgctacggttaaagtttcttggcttttcgttgggtgtagaccacaatggagcctacgcccgtccagcaaaacaatcgcaacaacgagtaaagaaagcattgaggttattaactaaacgtaatcgtggaatatctctgacaagaatgtttgaagaaattcagcgaaaaatgcgtggatggcttcagtactactcaattgggaaactaactgactttattcaacgccttgacaagtggttgagggcccgaataagacagtatatctggaagcaatggaagaagcttaaaactaaggtaactaacttacagaagctggggctgtcccagcgtgatgcatacgtcttcgctagtacccgcaagggctactggcgaactgcacacagtaagaccttgagctattctctaacaaatagaaaactggaacaactcggacttatgaatatgtccaagacgctccagtcaattcaaagtgattaagttgtcgaactgccgtatacggaaccgtacgtacggtggtgtgagaggtcgataattgaactaatcaattatctcctactcgatttattacatgattactttttcatgtaatggaatgctttttaaaattctttctccttactctcgcaatagttctatagagatccgcgaggcttgccgattgaaaaaggggaaaaaagcatataattcaagatatcaactaataagtgaagttgtgtcatattgtttaggaggggtaattgtatgttatcgaagaataatcgaaaggaacaattccggaaacaagagccgaaaaagcaacgttttgcaattaaaaagctcactgtcggagttgcttcagtccttattggttttacattcatggggatgaatgcttctgctaatacaactgcggaaacaaataccgcgactggcgatcaagcagtcgaagaatcacaaaatagtacttctgctaatcagactagtaacagtcaagtgccatcgactacttcaaattcacaaagtactaaatcaaatgataaacaagctgtttccgctgcacctgctcaaaagcatgaaaatgctgtttcagatgcaagtggtcaagctactaaggctgcagccgcaaagaatggtgacgcatcggtaacaacgtcagcttcatcttctgctgcttcagcaaattcggcgagtgatcaaagtcaagctttgtcatcaacacctgatactgtttcagttaatccaactgggacaccaatgcttgcttttgcaagattaaatgagtttgagccagcaagtcaaggtcaaagtgagtctggtgttagtgattatgctgatttcttgagtgctttacgcgattcaagggttggaactatcactttaaataatgacattgactttagtaatgcaaatttaaagcacggtcctaataatgggttatccggaacatatgaacgccttaataatactggaattgcacgtgccgtaactattaatggtaacggccacgagctaaagatgggagatcgttacattgaatttaccagtgctaatcaaaaaaagactgatagtaattgggatattcaattaaaggatcttaccttacaaactaccagtggatatggaccattctggtttgctaatacaccaggtgaagcggctaaaaataccattacttttaatggggtaactactactactgattcacatgaaattatgtggtatgacgccggtggtgcttcaactactcatgttaaattcgaaggcaataatactatcaacagtacgcttaatggtaatactgccgccatctatgcttatagcattgaagcagtaaatggaaatacgacctttaacgtaattgatagctcaccagctaatactggtactaatagatcagcaattttgatttcaattgatgcagctcatgcgggtaaagtcatcgttgataaaggtgctacattaactattaatggagataatcaagttaatgttccagaaatgaatagtgctgattcttatggtacgatgggaattcgtttccaaaactgggctaaaaaagatcttgataaagctaagaccagtgttgttcaagttaacggtaagttaaacttgaatatgggtaaaggtggttcaatcgctattttaggatcttatgtcgatgtacaaccaggcggtaatgttactattaatacgcaacaaaatggtactagcactcttgctggtgacttagctctaggtcatagaggtacccactttggtgtaattgctggtggtatcgaagctagtgatgattatgctggcttgagaattgctaatggtggtagtttaaagattgttcgtccaaccgatgtaaactctactcagcctttaatttcatatggtgatgcaggttcttctggtggtaaaacatttacagtaaatgttgaaaatggaggtactcttgatttacaagatggtgctactgatccacaaacttggagctttaataataccagtagcacggggaagactaatatgccgtgggctggtttgattactatgtggggaactagtggtacagatactattaaaattcgccgtttgtaaaattaagttagaaaaaataaaaagccatttgtgatagacttttgagtatccctaatcaaaagaaaggcaatcacaaatgacctataaacatcttaccacacgcgaattaactctcatagctgatttttggtatcaaggcactaaagcttatcgggccgctaaattacttcaacgtagtcaagaaaccatctatcgtgtttatcgtttcctcaataacggtaaaaccatcgaccaatatcttcagacttatcagcgtcataaacgtcgttgtggtcggaagcagacccaactgccaactatcgaggttaactatatccatgcacaaatcaaggctggttggactcctgatactattattggtcgtcatgaacacccgattagttgcagtatgcgcaccctctatcgcatgtttgcccgcaatcagtatggcttttccgttaaacagctaccgatgaaaggaaaacgccatcccaatggctcgctaaactgccacgtcactttgttaaatcaattacttttgataatgggaaagaatttgctggatggcgagagatagccaataagtatgatcttcatacctattttgcggaagtcggtgctcccaatcaacgagggttaaacgaaaataataacggcatcttgcgtcgtgacggtcttagcaaaaagctagattttcgccatttaccaaacgaactagtcactcagctaatgcaccgtcgcaacaatatcccacgaaagtctcttaattatcgtacaccactagaagtattcatgagttatgtcacagaagaacagctttcaacttttttctaatttaaattgacatttcgggattaataatcctaagtatattaatttgcaacgtactggcaaccaaactggatcattaatgcgccttgaaggtactacaaataatgtttcaattaatggcgatattaataatgttgttaccccattagctcaatgggatgaaggcgcaaaaaataatccttcatactattggtatattgagaatgaagctaaccagaataactggggtgattatgcaaatcgctttgtacaaagtggaaagaatcctgagcccactgcaaatgccggagttactacatttatgcattcaagcggtagtgtacagatggctcctaaccaggcaggaactaattcatccaagtttagcaatggagaagttgcccaaactctaaatgaagctataaattatcaagctccatatttgaatcaattcttaaatcactttagttggtgggcaccacaaagaattgccatgggaagcggtttagagaatgtagtaacaccaactgattcagaaaagtatcaaccgatagttcaaactattgatggtaatactaaccaaactttaagtgatttaactgctaaaggcgggatcaaaggtttactttctagcgatggtactgtaactactgatctttcttctgttaagaacgtaagctggtatgatgcaactactgatactgatgctactgagtggaagagcgtaatgggtgatgaagcagtaccaactaacccaactggtaatcttaagaccactgataaatcagcttgggcaaaagtaacctatactgatggttcagttgactttgctaatattccattgaatattactgaaccaatggcaaatctttacactccatcatataagccagtaaatgttgaacaaggccaaactgcgactgttgacccatcatttactgatcaagatggtaagggtactactgctccaactggaaccacatttacgactggtactgatacaccaaactgggctactattgatccatcaacaggtactgtaactgttaaaccacgtactgatgtaactccaggtgcttacaatgttccagtaacggtaacttacccagataagagtactgatgaaacgaccgtgccagtaattgttactaagcctggtcaaacagtaacttggggtgataatggtgctgttgtattaactactgatgcttcaaacactaaggctcacgaaacttcagacaactcacaagttgtacccgtttctgatgtaactgtaactgctcaaggttacaagttagtagatggcaagcttgaaactactgctactccaattactgttgatccatcaaacgttagctggaagacagctccaaacactaacgttgatgaagcaactgcagctggtaagactattactggcaacgaaattaacgtagacttgactggcaatgctgacgctcaagcaatccttggtccaaagaatggtgttgtaactactaacccattcactattgatgctaagggtgctggtgctaagaatgtcactgctccagttgatattaaacttggctcagacttgactagtgaacaatttggtcaattagtagataacaacatcccgactgatgaaattgctactactacttgggcaactaagccagatgcaaatggtcaaggcggcgtaattaagatcaccttcactgataaggatgctaatggtaatccaacttacttgaacattaacattccagcaagtttaatcaaggtaactactgatgcagaaaccaataccccacaaggtcaagatgtttcaactaaggtcggcgaagttcctgatgcagaaaaaggtatcaagaatcctggtagtttaccaagcggcacaacttacacttggcaagacactccagataccactaaaccaggtaagaaaccagcagttgttgtcgtaacttacccagatggttctaaagatacagtttcaactaatgtgttaagcaacaatttttgtgcattgtttgttgcgactactactccctaatagatataaggtttatagccttatatagtaggtatcataaaatagctgaacattgtttagataaatttgtcaaacggtagaatgataatgcttataagaaacccccgaatacttaactttaagcattagtagcaatatctcccccagataacttaaaagtcttattgtctacgccaacagcaataagcagataacagtttagttttatcatataagtgtatttgctactaaaagttttttactgttcatgacaattgtgctgaacaatgattcaacagtacacttagtactagcgatacctcaaaagtcggcacagaaattacaacagtatggtaaatgtgctagcctactgttgtaagccgcttggtggtaggttttaaatgttgaatggtggacttatcatcaaagttagttgtgcgtaaactaaccaaaaaaggattttcagaagtgaaaatccttttttgttttaaacaaaaattcaattgataaattaggaaaagtgtaataagataattgcagaatagaaaacacgaatgcatttcaagtaggttgttcagagaagcagcgggtggtgggagctgtcgaccgaaactccggtgcaaaaatatgtgggcaggtaattctgcacggatagtagccgttatctacttcgaagggtgactaaagatagtcaaacttgggtggtaccgcggaactagagccatttcgtcccaaaatataaaggatggaatggctcttttttatataattaggaggaaatacgatgttagatattaaaaagattcgtcaagaacctgatttttataaggaaaagttagctacgcgtggtgtaaaaccagaagaaattgatgaagttattgcgttagataaaaagcggcgggaattgctccaacaaactgaaacaatgaaggcgcaacgtaatgaagcatcaaagaagattggagaagctaagcgtaatggtgaatccgccgatgctgccattaaggaaactcgtgaacttggtgataagatcaaggaattggatactgaagttgaagcaaatgatgctgaacttcatgataagatggctcatcttccgaatgttccacatgatggtgttccagttagcttaacggaagacggtgccgttgaattacggaaagtcggtaaggtgcgggactttgattttgaacctaagcatcactgggatatcggtgaaaaccttggtattttagactttgatcgcgctggtaaggtttctggtgcgcgttttgtctactacttaggtcttggtgctcagcttgaacgggcagtttataacttcatgcttgatgaacacatgaaggaaggatataccgaagtcttaccaccatatatcgtcaatgctgattcaatgtatggtactggtcaattccctaagttcaaagaaggagtttaccaggttaacggtgaggatatgacattgatcccaactgctgaagttccattgactaattactaccgtggcgaagttatcccaactgaagaattaccggtttatgttactgctttaacaccatcattccgttctgaagcgggagcagcgggtcgtgatacccgaggattgatccggatgcaccaatttaacaaggtagaaatggttaagtacactaaaccagagaactcatgggatgaacttgaaaagatgacggctaacgctgaaaacatcttgaagaagttaaacttgccataccatgttattaccttaactactggtgacatgagctttacggcatctgaaacccatgaccttgaattgtggatgccagcacaaaataagtatcgtgaagtttcgagttgttcaaactgcttggacttccaggcacggcggatgcacacacaataccgggatgaaaatggtaagttacaatatgttcacacacttaacggttctggtttagccgttggtcggacagttgcagctatcttggaaaactatcaaaacgctgatggttctgtaacaattccagaagtattggtaccatacatgcatggtgttactaagattactaaggaaaatgcggttcctttccgtaataaagttaataaataagatatatagaagacagcttttaaaaaagaagttcggattgctaaatctgagcttcttttttgattaaaaaaatctaagaaaaagtgaaaaataaataaattatacttaataaaattaacttatcgttggttgttagctttaaaaatcattgtttaaaacgctgacatcttggataaacacaaactttaatgaagaatatttattttattttctggcgatgataaagtagtatcaacgttaaaatttgattaaaaaggagtcggtgcagatgcatagcagcaagataaaaaatatgatcatcaccattgttgcagttcttggaattgtagtggggtggcaaatggtcgaacctcagcaggtatctgctgccgaaccgacttatacgtttgcaactaataacacctttgaaccctttgaaattcaagatagtaaaggtgggtactcaggaaagaatcctgggattgaaattgaaatacttaagaaaattgctaagcatgagcattttaagtatgaactgaagccaatgagttttaatggtgacttacaagctcttgaagcaggacaagttgatgcagtaattgctggaatgagcgttactgatgaacgaaaagaaaagtatgatttttcaacaccttactatactagcggggttgttatggctgttgcaaaagatagcaatattaagtcgatgagccaattaaaaggcaaaacagtttcggctaagtcaggaacgagtgcggcattatttttgaagaacaaccaaaagaaatatggttacaaaattcgctactttgattcctcaaatacgatgtggaatgatgtgaaaactgggaacacagtagctacttttgatgatggtcctgttcttgaatacggaattaaagaaggtgtcccacttaagattgtgacaaagaagccaattgatgcacaaccagttgctgttggataccaaaagggcaagaacttagaattacagaaaaagatgaatgatgggattaagtggctaaaagatactggccaaatggatcaaatcattgataagtatactaagagtgacaaaacgacgaagggcagcgcgactgatcggacaattttgggattaatccgcgccaattatccagccttgcttcgtggattatggatgacaattgaattaaccgttgtcggcattatttttgcgatgatttttggagtaattctaggtgtattaggtattgcacaaaacaaatttgccaatgctgtttctagtaccctgatttatatcttccgtggtattccaatgattgttttagccttctttatttacatggggattccaaatgttattggccataaagttccgttattcttagcaggaatcttaacgctgacttttaacgaaggggcctatattggagccattgttaaaggtggatttgaatccgttaatattggacagtgggaagcagcacggagcttagggttgccatatagcaaagccttgattaaagttattgctcctcaaggatttaagttaatgattccttcgttagttaaccagtttattattaccttgaaagacacctcaattctttccgcaattggtgtaatggaacttacgcaaacggggactgttatcatttcccagaacatggaaggatttaagatgtggttaatcattggaacgatgtatatcattatcattaccctgttgacttggttatcaaactacgtacaaaagaggatgggttaatatggataaaaactataaagtacaagtaaaaaatctgcacaaaagttatggaagtaatgaagtgctgaaaggtattagcttggacgtaaaacccaatgaggtggtttgcatgattggaccatcaggatcgggtaaaagtacctttcttcgttgcattaataagcttgaagaaccaaatagcggccatatttatattgatggttacgatattgctgatccgcaagtaaatattaataaggttcgggaaaatatcgggatggtttttcagcactttaatctctttccaaatatgaatgttttggagaatatcactttggcacctgttcaacttggcaagatgaccaaggaagaggcagaaaaggacgcgatgcactatcttgacttagttgggctagctgataaagcaggggcagatccaactaagctgtctggagggcaaaagcaacgggtagccatcgcccgtgcccttgcaatgaaaccggatgtaatgctctttgatgaaccaacgagtgcccttgaccctgaaatggtaggggatgttttggaagtaatgaaacggttagcgcaagagggaatgaccatgatcgtggtaactcacgaaatgggatttgctaagcaggttgccgatcgggtggtcttcttccataatggtgatattcgggaacaaggcactccagaagagatttttgatcatccacaacatccagatacgaagaatttcttggataaagtgctaaatatttaattatcgcctgacttttagtaatttaaatttgacaaagttaggataatcattataataatgagtaacttttaataattggttgacagagaatctagcatttgctgaaagctggatccaattaaatggcatgagcgtttgaaatggagtggtttccttatcaaccgagaggtagttcgcaaatgtgagctataaagatgggtggaaccgcgttaaaaaacgtccctggtagatgattaccagggacgtttttatttgtttaagaaaacgtttttgttattaactaaatttttaaggaggcatattatggacgaaaaacaacaacagaagttagaacgatcgcttaaaagtcgtcatgtgacgatgattgctattggtggagctattgggaccggtctttttcttggatcaggaacagccattcaccaagcaggtccttcaatcattctttcatacctgatcgtcggtatcttttgcttctttatgatgcgggcgttaggggaacttattttagctgatacttcaaaacattcatttattgattcggttaaggaatatcttggtgaccgaatggaatttgttgctggatggatgtactgggcatgttggctaacattagcaatggcagatcttactgctactggtatttacttaaaatattggttccctaatttaccacaatgggttggtccattaattattgttattttattgatgttagtaaacatggtaaacgttgggctgtttggtgaactagaaagttggttctccatgattaaggtgattgcaattttagccttaatagcagttggcgcggtcttacttgtgatgcatggtcatgttgaagggcggccggtaaccctttcaaacttagttaaccagggtggctttttccctactggtccgatgggcttcttaatgtctttccaaatggtagtctttgcctttgtgggaattgaaatggtcggtttgacagctggagaaactaagaatccagataaagatattccaaaagcgattaataccttaccagtccgcattggtttgttctatatcggatcaatgattgcgatgatgtcaatttatccatggttccatattaagactacctctagcccgtttgttcaagtgtttgcagcaatcggtgttccaggagcagctgcgattttaaactttgtggttttgacggctgcaatgtctgcgactaacagtgcgatctttagtactagtcgttccctctactcattagctcgaagcgggaacgcaccaaaacgttttggtgaattaagcgcgaaggcagttcctaatcatgcattaactttctcttcattgattctttttatcacagttatcttgaattatattatgccagcgggaatattcgatgtaattgctggaatttcaacaattacctttatttttacgtggatcattattttggttgcacatattaagttccggcggcagaatccaaagggagttacgaatttcagaatgccaggatatccgattactagttggttaacaattattttcttcttggcagttctagtaattttactctttattgattcaacacgagttccattaatcctttcaatcgttatttttgcattgcttgcttatggttatggatttttgaagaagaaaaattaaaaacttggcagaggctcgaaaattttgagtctcttttcttttgcatttgataatgaatagtttaagagagagctaaaaagtaatagaaaagttggttttgtttaatagttggaggggatctaaatcccgttgtgacgcggtttaattgtctttttgttggggagggattatactgaaagtgtggaaagatagaaggccgaatttaacaaacatcttctcataataaaactactttgaagtacgttaattagactttttgcatgaaaataccaacaccccactccacatgaaacgctttagtttccgtaaaaagtatgttagctaaaagtaattagtggccatatctacaacgaacctataatgataagcttaagttcctcgtattaaacagatagataagttaccaaaaattaaaaataataatgctcggcctttcttcccacttcttcatggttgagaagctcggaatgttatatcgataaacgttccgggcttctgccagtttaaaccctaaagatttcgtattatttcctgggaaatacgaaagttagtgaaactgtaaattacttctctaaatatttgaacatttgctcaattgattttaattgagtataatagaaaaccttggcaggggcgacggaaagacacatagcaaagacgatttgccacgtgtaactttccgtttctttttgttaacatatgacagcgttttcataagttctaaaaaaactttgtgaaatttccggaagttgaaaagttaataaaatgagcgaattgtaaaattataatttaaaaaatgataaaaattcacaaattgtctacaaaacagcgctttacaggaagcaaatttaaagatattcttaaatagttaactcgccacaattgcaattatagtatcttaatttggaacggctgttaacgaatattctatttaaggagggtacacagccatgtctatgtatcttattatcaacattattgggttgattgtctttcttggaattggatggcttttctccaagaatcgaaaggaaatcaactggaagactgtaggagtcatggtagtattgaacttacttttagcatggttccttgtaagttcagcagctggtcgtgctggggttaaagcggccgctgatggttttgcttggattgttaacgtctctgcaaaaggaactgtgtttgcattaggtgattggtacacaccaaagaaccttaacttcatttgttctgcattgatgccaatccttatgattgttccattgttcgatatcttaaactacattggtgtattgccatggattattaagtggatcggacgtggactttcattcattactggtgaacctaagtttgaatcattctttgctgtagaaatgatgttcttaggtaacactgaagttttggctgtttctggtatgcaattacgtgccatgaataaggaacgtaatttgacaattgccatgatgtcaatgtcttgtgttactgcttcaattcttggtgcatatattgaaatgatgccaggacaatatattctgactgctgttccaattaacattattaactcattgattgctgtaagtatgttaaaccctgttaaggttccggctgaagatgacaccatcgaaaaggttggtgcggaagttgactctgataagcgcgaaccattcttcagtttcttgggcgactcaattttaggtgctggtaagttaatccttatcatcattgctaacgttgttgccttcgttgctttggcagccttgatcgatgctatcttagcattgttctggaaggacctttcacttgaaagtatcttaggggttatcatgttcccattctcatggttacttggtttacctgttcaccaagcatggatgctttcccaagatatgggtatgaagttgattactaacgaattcgttgttatgggtaaggttactggtgaaatcaacagttacgcacctcacttgcgggctgtcttgactgtcttcgtaacttcatttgccaacttcggtactttaggtatgattattggtgccttcaaaggattagttgacaaagaaaacaacgattacattgcttcaaacattggttacttaatgctttctggtattttggtttcattattatcagccgcatttgttggtctctttgtttggtagaaatggaaaagcagctgggaaggctgcttttttcaacattaaatccgaaaacgcttgcatgataaaaaggagataaaattatgactacaaagattattatggatactgacccaggtattgatgacgcagctgctttaacgatggctattaatgacccatcattagatttgaaattggttacaacagttgctggtaatgttacagttgataaaaccactgccaacgctttgaagattattcacttcttcggtaaggatattccagttgcagcaggtgccaagcaaccattgattaagccttttgaagatgctgcccgaattcatggtgaatcaggaatgcctggttatgactttggtgacgattatggtaagcctcttgataagactgctgttgaagcacttcatgacgcaatcatggctgaagatgaagtcatcttggttccaactggttcatacactaacattgcattactctttagcgaatacccagaagtaaagagtcacattaagcaaatcgttgcgatgggtggttcattctctggcggtaacatgaccagtgtagctgaatttaacgtcttcactgatccggatgctgctaagattatgtacaatgcgggtgttccaattgtaactgttggattggatgttaccttaaaggcgctcttaactgcggatacgattgaaaaacttggtagtcttaataagactggtgaaatgctacatggattaatcacgcactataatgatggtagtgatcaagggcgtccaatgcacgatgttaatactatcttctaccttcttcatccagaagcatttactacgaaggacatgtgggttgatgttcaaacagacggtccagcaatcggtgctactgttggtgacattcgcgctgcttaccatgatggcaagaccaacgcaaaagtttgtttagatattgatgctgaatacttcaataagtggttcttagaagaagtaagcaaaatgaaataagatactaagagctgagagtttgctttcggctctttttattactttctagtgtaagcgcttcacgatataatagtaatagttaaagtaaggaggaaataccaaatgaagaatataatgattgccggcgctggcgtattaggtagtcagattgcatatcaaacggctttatccggctttaatgtcagcgtatataatcaccatattgataccgctgagcgacggattaaggcgctgaaaagtgattatgaacgtgacttgcatttgactgataaggaatttcaacagggccttaataatattaaagtgattactgatgatgttgcgaccgcggttaaagatgctgatttaatgattgaagcattaccagaatcgttagagttaaaggagcagttttacgaagaggtttcagaattagcccctgaaaaaacaatctttgctagcaactcctctacatttatccctagccaactagctccttatactgatcggccagaaaaatttcttaatatgcactttgctaaccaaatttggaaatttaatgtggtcgaaattatgggcacctcccaaacaagtccagaggtgattgaagaagctacaaagtttgcccgggaaataaagatggttcctgttatccttaataaagaacaacacggttatattctgaattcccttttgattccgttacttgcatctggtcttagtttatgggctaaaggagttgctgatccagcgatgattgataaggattggatgatttcgacaggtgcaccaatgggaccatttggtattttagatatggttggtttacggacagcagcgcaaatcgaacggaatgcctatgcccagactaaggatgaaagtcataaggaaattgccgataagatggaacagatgattcaagaagggcacgaaggaaaagaatcgggacaaggattttataattatccgaatccagccttcatggatccagattttctgaagcattaagattaagtattgaaaacgttaggaaagggagcaagataagagtcgctcgtgactgttatctcactcccttattttgcgctccaattttcacgtaatccggttgcaacaatggcaaaattacggtacagtagtagagaacgtgaaacaaaaaatgtttcacgaaaggagacctaataaatgaatcctgaacaatttcaacaagcattagctgatcatggtattaccttatcagcagaacaaatgcaacaatttgctgactattaccaattattagttgaaactaatgaacatgtaaatttgacacggattactgaaaagaatgaagtgtatttaaaacatttttatgactcaattacaggagcgtttgctgaaccacgcttagagagtgaagacctgacattatgtgatatcggtgctggggccggctttccttccttaccgttgaagatcgcttttccacagttaaaggtaacgattgtcgattcgttaaataagcggattgcttttcttgaagacttagttgccaagctcgggttaaccggtgttacattgattcatgatcgggcagagacttttagtgctaagaccagtccatatcgggagaaattcgatattgttaccgcccgcgcagttgcccgcctatcggttttgagcgaattatgcttgccagctgctaaagttggtggggaatttattgcttataaggcaagtgctgctcccgaagaactccaacaaggtggaacagcaatcaaacagcttggtggaaaagttcaaaaaacggtgacattgactttaccgggaactgatgaagaacgcaatattattgttattgataagataaaggcgacccctaagaaatatccacgtcgtcctggcttaccaagtaaaaaaccaattcaataagataaggagttgaaagtatggctttttcattatttggtattggaaaaaataattctgataatacaaaaaataaggtcgtagaagtaaaaattgatcaaatcattcctaaccgctatcagccgcgaaaggtttttgatcaagacggtattcgtgaattagcacagacaattgatgaacacgggttgttacaaccaattgttttgcgtgaatacgaaccaacaaaatatgaaattattgctggggaacgtcgataccgggcgatgaagcttttgaagtgggaaaaagcaccagcaataatcgaaaagatgagtgatcaagaaactgcatcgcttgccctcattgaaaatctgcaacggtcgcaattgagttcagtagaagaagcgcaggcttaccggcaattaatggacttaaaccatcttacgcagtcacaattagcaaagggaatgggaaagagtcagtcctttgttgccaataaattacggttacttcgcctgattactcctgtccaaacggctattttagatcaccggattacggaacgtcatggtcgagcattgttagatttagatgaaaagcaacaacgtgatatgttaatgcggattgttaatgaacggttaacagttcggcagacggaagatgaagttgctcgtttgctaggacgtcctttaccttcagaaattgcagaattaaaagcagctgctaagcgcaaagaactggcatctattgaagatcatactgaagaaacagcagacgttgaagaagtatcagtagagaaaccggccgaaaagaagcgggctcctaaacgaaagacagctaagaagtcccaaagtaaaaaaactcagcaggttaatgatgcgcgtttagctttaaatacgataaaaaaatcaattaagctggcgacaaatgaaggctttgaaataaaaatgcatgaggaagaaaacggtgatacttatcaattaacaattgagattccgaagaaacagtagggaggccaaaaaatgggttctgtaattgcccttgcaaatcaaaaaggcggtgttggtaaaacaacaacgagtgttaatttgggtgcatgcttagctgagactggccagcgcgtcttattaattgatcttgatcctcaaggaaatgcaactagtggtttgggcgttgaaaaacagaatattaagcaaagtatttatgatgttttaattaatgaagtgccattagaggatgttattcaaaagacaagtcacgagggagttgacattgctcccacaacaattgccttatctggggctgaagtagaattaactaatttaatggcccgggaaacacggctgaaggattcttttggggaaattcgtcaaaaatatgattttattttaatcgattgtccaccatccctggggctcctgacgattaatgcatttactgcttgtgactcaattctgattcctgtccaaagtgaatattatgcattggaaggtttaagtcagcttttaaataccatcaagcttgttcgtaaacacttcaatccgcaacttaagattgaaggggttcttttgacaatgtttgaccggcgcacaaatcttggacaacaggtaaattctgaggtcaaaaagttttttggtgaccaggtttatgatacgattatccctcgtaatgtccgtttatcagaggcaccaagtcacggcttagcaattattgattatgataaaaattcaacgggggcacacgtctaccaacaattagcaaaggaagtgttggctaaccatggcaaagaataaaaaaggtgggcttggtcgaggtattgaggccctctttgcggaaaatgaagtaactgagcttgcggatgaaacggttcaagatatcaagttatcgttaattcatcctaatccctatcaaccacggcgaacgtttgataaagaggcgttggcagagttagcttcatcgattgaaaaatcaggggtgtttcaaccaattattctgcggcaaacggatccaaaaattaaccgttatgagctaatcgctggggagcggcggtttagagcttctaagatcgccaaacagaaaactatcccagcaattgtgcgtaagatgagcgatgaccagatgatggaaatcgcggttctcgaaaatcttcaacgtgaagaccttacaccacttgaagaagcgcaagcctatcagatgttaatggataaattatcattaacgcaggcacaggtggcaagcagattaggaaagagtcggccttatatcgccaattacttgcggttactaggtttgccaaaagtgatcaaagagtttcttaataccggtaaactttctatgggacaggcacgaacaattctcggtttaaaagataagtcaaaacttgttccgcttgcccaacgagctgtcggacaaaatcttacagtgcgacaattggaagagattgtaacgcagactaatggaacggccaaaaagaaagaagaacggcggacgcaacgaaaaccaatctatattcgagaagctgaatcacagttgcagagtaaatttggtacaaaagtcgctgttgcgcaaagtcggaaaaagggcgcaggaaagatcgaaataccttatacatcgaatgaagactttactcgaattcttgaattattaaatataagcttagattaaggaggaataactcatggcagcatatgataaaggtgacattgtaatgatgaaaaaggctcacccatgtggaactaaccgctggaagattacgcgagtgggtgcagatattaaaattgaatgccaaggctgtggtcatattgtcatgatgacccgtcagaaatttgataagggattaaaaaaggttatcgaaaaagctaatcaagctgattaatatttttaatgattgatgatcacaaataactaattgtagattaaaataataaatgattaattgaaagggaaagtgaacaatttatgtcattaactgcaggaatcgttggtttgccaaacgttggtaagtcaacactttttaacgcaattactaaagctggtgccgaaatggctaactacccattcgcaacaattgaccccaatgtggggatggttgaagttccagatagtcgacttgaccggatccaggaattaattccagcgaagaagatcgtcccaactacctttgaatttaccgatattgctggaattgttaagggtgctagtaaaggtgaaggactaggaaacaagttcttggaaaatattcgtcaaacagacgcaattgttcatgttgtgcgggcatttgatgataatgatattactagtgtttctggtaaagtggacccaattgaagatatcgatactatcaacttggaattagtaatggcggacttagatgctgttaataagcgcttggcaaaagtacagcgggctgctaagggtcgtgataaggatgctttggcagaattagaagtgctcaataagattaagccagttcttgaagatggcaagagtgttcgctcaattgactttagtgatgatgaacaaaagattgtcaaagggctgttcttattaacaagtaaaccagtcttatacgttgctaacattgctgaagaagatatggcagatccagatagcaacaaatacatggatgcaattaaagaacatgtaaaagatgacggagaagttattggcgttgcagcagctgctgaagaacaaattgccgaaatggatgaagcagataaagcggatttccttgaaatggaaggcgttactgaaccggggttgaaccggttaattcgggcagcctacaagctcttaggtcttgaaacattctttactgctggtggtcctgaaacgcgggcctggacttacaagaagggtacaaaggctccacaagcagcaggaattattcactctgatttcgaacgaggatttatccgagcagaagtaatgagctttgaagatcttgatgaattaggttctgaatcagcagtaaaggaagcggggaagctccgtcttgaaggaaaagattatgtaatgcaagatggggatattgttgaattccggttcaacgtttaaacctctgaagctaagagaggagtagttttatagtgagtgaagaacaaccacggaatgcacaagctggtcaacgtcaaaaacaattagaaaaagaacggcggcaagcgaatggaaatgcttttagcaactatgatctaacacgaaaaaatgaagattttatgtatcaattaaataaacagttggatcgtctcggtgttccttcagataagaaagactcgatgctaaaggaaaccattgataaattgctagcaggacaaaagaaggggcaaactgcgcgggcattatttggtacgccaaccgaatatgctaaagaattgaagaacccaaagccaactcctgctgaagcaagtaagcaatcaattaagttgttagcaattgataatatgctgattttcttgagtatctttacttttatgtttggcttaatgttctggttatcaccagctgcaatgcaaacaaagaatgctggaagcagtggtattactgcaatcttaatcgtggcgatcactggaggattgatttttggttatgtggctacccaagttcaaccgcaaattgataagaacggtaagcgggtaagtaagaagccattatggcaacgaatccttttgatagttgctggattagcagcttggttgattatttacatgcttgtaagtatgttgccaaatgtaatcaacccacgacttaatccatgggtctacattggcattggggttattactttcattggggatatgtacttcaggtccaaattccatgttacaggttccctttacggtaatcgtgcgccacgacgttaaccagcaaatagtcttaacaacggaactattttccagggtatctttaaaataactgagagtgagaaaaggcaaaagttttttctcactcttttctttttgctcttttttgaaataaatttctgaaaatctatggacaaatgttcaatagattgttaagatataaacgtaatcttatgaaaacgcattcaaagttgagaggagatcatattattatgaagttaacgcaagcacaattagcaaaatacatggatcacacaatgcttaaaccagaagctactccagagatgattgataagacagttgaagaagctcggaaatacaacacagcttcagtttgtatcaatccttactgggttaagcgagttcatgaaggattagaaggtactgacattaacacttgtacagttattggcttccctctcggtgcaacttcaacagaaagcaaagtttttgaaactaagcaagcaattgaagatggcgccgatgaaattgatatggttattaatatcggtgaattaaaagcggaaaatgatgatgcagttgttgctgatattaaggcggttgctgatgctactcacgaaaagggtaaacttcttaaagttattattgaaaatgctcttcttactgatgaagaaaaagcacgtgcaagtaagcttactgtaaaaggcgatgctgactttgttaagacttcaactggttttttaacttcaggagctaaggtagaagacgttaagattatgcgtgaagcagttggaccagactttaagattaaggcagctggtggaattcacagccttcaagaagcttacgatatgattgaagctggtgctaaccgtttaggtgtttccgcttctgttcaaatcttagaagaagccgcaaaacaataagaataaagtttaattactaatcttaatttacagaaataggaggagtcagaaaatgtcatataaacgtgtttttgttattgtaatggactcagttggtacaggtgccgctcatgacgccgcaaagtttgatgatgttggatcagatacgcttggccacgttggtgagtattacaagggtgccttgaagctaccaaaccttggtaaattagggattagtaatttgcgcgatactccgattgaaggggttccagttgctgatccagctattggtgattacggtaagatggaagaaatttctgccggaaaagatagtatggatggtcactgggaaatgatgggtttaccagtaatgaagccattgtcaacgttccctaatggttttccacaagaaattgttgataagcttgaaaaattctcaggacgaaaggttattgttaacaagccatactcaggaacagaagtaattcatgactatggtgaacgtcaaatggagaccggagaattaattctctacacgtctggtgattcagtaatgcagattgctgctcatgaagatgttattcctgttgaggaactctacaagatttgtgaatatgcccggacacttgttaatggtccagaatatactgttggtcggattattgcccgtccatatgttggtcccgataaagatcactttacccggactgctaatcgacatgactttagtttgaagccaattggtgagactgatatggatcgtcttcgtgcagcagggtacgatgtaattggtgttggtaagattaatgatatcttctctggtgaagggatcgataaaggataccataacgaaagcaacatggacggaatggatcatgttgatgaagtaatgaagcaagactttactggtttctgtttcacaaacttggtcgattttgacgcaatgtatggtcaccgtcgtaatccaaagggctttggtcaagcattaatggactttgataagcgtttaggcaatgttcttgatgaaatgaagccagatgatcttttgatgataactgctgatcacggtaatgaccctggctttaagggaactgatcatacacgtgaaaatgttccattgttggtttactctccttcaatgaacaagccaaatcaatcccttggggtgcggaagacattctcagaccttggtgcaactatcttagagaactttaacgttgaaccagtaaaaggtaccagcttctacaaggaaattagtaacgattaagattaattaaggaaaggggcgaaacacgatgcgaatggttgatatcattgacaccaagagaaatggcggcgttctgagtgatgagcaattacaattctttgttgatggcgtcgttaatggaacgattcctgactatcaaatcagtgctctccttatggcaatctacttccaggatatgaccaaagaagaacagacgagcctaacaatgaagatgatggagtctggtgaacgattagatttgagccgaatccctggaattaaggttgataaacattcaacgggtggtgttggtgataaagtgagtctgccacttgcagcaatggtcgccgctacaggaattccggttccaatgatttcaggtcgtggccttggtcatacaggaggcacgcttgacaagttagaagcgattccaggatttcgggtagaactttccgaagatgagttcattaatcaagttgccaaagaaaaattagcaattgtaggtgcgactggtgaggttgcgccagcggataagaagatttatggattacgggatgttactgacactgttgactcaattccgttaattgctagttcaattatgagtaagaagattgcttctggaacagatgcgcttgtaattgatgttaaaactggtactggtgcctttatgaagacccttgatcaatcaagactactggctaaagcgttagttgagattggtaaacaagcaggattaaagtgcatggcagtaatctcagatatgaaccagccacttggaaataaaattggtaatgcccttgaaattgaagaatcaattgatgtcttaaaaggaaagggaccaaaagatcttactgaattagttttgacgcttggtagttatatggttgtaatgggtgaaaaagcacaaaacactactgaagcacgaaagatgttagagcaaactattcaggatggatcagcctttgaacggtttgcagcaatgataaaagcacaaggtggagatccagctgttgttgataactatcaattaatgccgcaagctaaatataagattccgttcaaagctgatcgggatggagtattgacaaagctttcagcggatgaagttggaactgccagcatgttattaggcggaggccgtcaaaaggcagatgatgcccttgattatagtgtaggaattgaattacaccataagctgggtgattacgttaaagatggcgaaccaattttaacaatctatagtaaccgccaagaaattccagatatagaacagttgctaagagaaagtattaaaattagcgatgatggcaaagtaccaacgttaattcatgaaattattgaataaagagacaggaggatatttcaatgagtacacatattaatgcaaaaatgggtgactacgcagacactgtattacttccgggggatccgctgcgtgcaaaatatattgcagaaaacttcttggaaaatgttaaacaagtaaattcagtccggaatgcctttggttatactggtgaatataagggtcatcgtatttcagtacaaggatctgggatgggaattccttcgatgtcaatttatattaatgagttagtacgcgaatttggtgttaaaaccattatccgggttggttcttgtggcggaattgctccagatgttcatgttcgcgatgttcttcttgcccaaggttcttcaaccgattcagcagtaacggtaaatacatttggaccaggattccattacgcaccattagctgatttcaagttgttagatactgcctatcatgtagctggtaaattaggtattgaaacaaaagttggagatatctttgctgccgatcgtttttacaatgatgagcttgatatggaaaagcttcgtgactatggaattttaggaacagaaatggaatctgccggactttacttgttagcggctaagcttcatttccgggcactttcagttttgactgttagtgacttaatctttggtgacgaaaaagcaactgctgaagaacgtgaacgaacatttaatgatatgattaatatttcgcttgaaacggcgattgctggaaagtagcttcttgcataggttagagaatgcattttataataaaatgtggtttagataatgaaagagactgaggtaatgcccagtctcttttaatatgggaaaggagggggattagatggatgataaaaataagattgaattagcgctaaaagtagcaaccttatattatcgtgatggatggaaccaaagcgatattgcaactgaactaaatatttcccgggcaacagtgtcacgattattacaatttggtcgggatcgaggattagtaaccattaaaattcataatccagttgctccgcttcaccagttggaagtggacttgctcgctaaatatccatcattgcataaaattattattgttccaggcacggatgatccacttgaagaagttggtgcagcgggtgctaaatatatcgaacaagtcgtagaagataaagatattattggattaggctggggaaaaaccgtctatcaagtaggattgcatttgaaacctaaagacgttactgatattactgttgttcaaatgaaaggcagtatggcaaatactaatacgcgaaattatgcgtttgaaacggttaatatctttgcgaatgcttttaataccgttccccagtatttgccgttaccagttatctttgatcatgcaaagacacgtgaattagttgctaatgatacccacatcaaacatattttgaaattaggggagcagtctaatatcgctgttttcacagtgggaacagtacgtgactcagcattgttatttaaattaggttacttcaccaagcaggagcaattaacattacaacatgaggcggtaggggatgttttctctcgtttcattgatagtaagggtcagatagtaaatgaagatatcaatcaacgaacaattggaattgcacttcctgagttgcaaaagaaaaaacacagcattttagtggcggcaaatgttgctaaagtaccagcagtacatggtgttttgagtgctgggtatgcgaatacattggttattgatcaagagagtgcaaatagtctagttgatttttaaattaatttaaatttttagattgacctcagtgcgaaatcctagtagagtatacctaattaaaaatcaaaggagttgcactacagatgtcaaattgggacacgaaatttgccaagaagggcttaaccttcgatgatgtattacttattccagccgaaagtcatgtattaccaaatgaagttgacttgagtacacagttagctgataatttgaagcttcatattccgttgattagtgccggaatggatactgttactgaaggaccaatggcgattgcaatggccttacaagggggcttaggggttgttcacaaaaatatgtcaatccaagcccaagcaggagaagtggctaatgtaaagagcgtagtcgtacctgcaggcgcaactaaggctgctgttgatgataataatcgattattggttgctgcagcagttggggttactagtgatacttttgaacgtgctgaggcccttttaaaggcgggcgcagatgctatcgttattgatacagctcatggacattcagcaggtgttcttcgtaagatcgcggaaattcgcgaacacttcccagacgcaaccttaatcgctggtaatgttgctactggtgaagctactcgcgccttgtttgatgctggtgttgacgttgtaaaggttggtatcggtcctggttcaatttgtactactcgggtggtcgctggagttggtgttccacaaattactgctatttatgacgctgctagtgttgctcgtgaatataacaagccaattatcgccgatggaggtattaagtactctggtgacgttgtaaaagctcttgctgctggtggtaatgcagtaatgcttggcagtatgctttctggtacgacggaagcacctggcgaagtttttgaagacaatggcaagaagtacaaggcttatcgtggaatgggttctgttggtgcaatggctcaagcacatggttcctccgaccgttacttccaaggtggagtaaatgaagctaataagcttgttccggaaggtattgaagctcgggtagaatacaagggcgatgtttctgatattgttttccaaattgatggtggtcttcgttcaggaatgggttatgttggtgctggtgatattccaacattgatcgaaaaggcccaatttgtccaaattactaacgcaggacttattgagtcacatcctcatgatgtccaaattactcgtagtgcacctaactataaataattaattcaataaggaactgctatggctttattcgtgaagatatagtcacagcagtttttatttcccgagaaataatggagggtaaactttttgttaaggctatcctagaatgatcgcttttttcgcatagttagttataatattcaataggatattatgctgtaaaaaggagtacctcttatgaaaattctagttgttgatgatgataaagaaattgttcaattacttgaaatttacatccgaaatgaaggatatgagccaatttctgcttacgacggaaaagaagcattgacaaagctaaatactaatcctgatatcggtctgattattcttgacttaatgatgccagaaatcgatggaatggatgtaattaagcgggtgcggaaagattctgatattccaattttagtgctttcagctaagacggcagatatggataagatacaaggtctaatcactggggcggatgattatgttactaagccatttaatccgcttgaagtaatggcacgagttaaatcattacttcgtcggagccaaggagaagtgacaaatgatcaaccagatattcttaatgttggtccattattaatcaataaagattctcacgaggttaagacgattaaaggggatgtaattcaattaacagcccttgaatttggtatcttatacttacttgccagtcaccctaatcgtgttttctcagcagatgacatttttgagcgggtatggcaacaagaaagtgtcgtatcagctaaaacagtcatggttcacgtgagtcatttgcgggataaaattgaagaagcaactaacggtgaaaaggttattcaaactgtgtggggtgttggttataaggtggaagaccactaaagcctagccttaatgatgtggaggaaaaattgtgaagttaacggggcgtgaaaagagttcgcttattttagaaggggtagtaacggttatcttattgttattgctgaacatggcgattatcgtaattattcaagatgccattcagtcaaatccgggagtaaccaatggaatctttatgattaagcaatcattgaagattggcccgcttcaagcacaaatatggagctatcagcggatcttaattgcctttttagtaattattgatgtgtgggtagtatggtggcgattacgtcgtcggtaccacctttatcaaatggatcatattatcgcggaattacactatattgcgcagggacatttggatcatcgaattccgtttcggctaaaagggaatcaacagcatgttattactagtgtaaatgcattagttgatagcgcggtgcggtcgatggatgatgaacggaagattgaaaagtcaaaagatgagctgattactaatgtgagccatgatttacggacgccattgactagtattattggctacttgggattgattgaagataagcagtatcgtagtgaggaagatattctaaaatatacccatactgcttatgagaaagctaagcaaatgaagaccttggtggatgatttgtttgaatatacaaaagttcagcaacatggggcaccagtaaatattatgaaaatcgatcttaaccagttaattgaacagttaacggcaagttttgaattagaagcccagcatcgcggaattgaaattacttcctcagttatccctaatcctttaatgattgaggcggatccggagaagcttgggcgggtttttaataatttagtttcaaatgcctttaaatacggcaatggtgcaagttacattcggatcaatgcccggcaagaaaatgatatggtggtcgtcaaagttgctaatgatggtacaccaattcctgaaaaagcacttgaccacctatttgagcgtttctaccgcgcagaagcttcccgttcacgagctactggtggaacgggattaggtttagcgattgtcaaaagcattgttgatcttcatcatgggagcgtcaaggttacttcaactgaagacgaaacagcatttattgtcacattacctttaaaacaagaagttaaagaaaacaagcaaaaatgagaaaaaagtctaaaatcatttgattttagacttttttctttttcaattatattcaactaattttatatgtggtagactaaaagagcattgtgtcacttgatattataaaagatacaaattattggaggaaattctgtggctaaagcacaaataaatccagaaaggacacgctggcttgaggtgcttggtgtctcaatgccattgtgtcttagttatattccgattggattggcctgtggaatcttactacacgcagcaggtttaaactttataatgattttattggtgtcggtattagtgttctctggtggggcacaatttattctggcatcgttattagcaagtaacgctccattagggactatctttatctcacttttcttcttggagttacgatatgcattgttaggatcgagtttatctaaatatattaaggataaatcagcacgtttcatcctcatcttttctgcatcaatgaacgatgaaaactatgctgttaactatatgaagtttgcaactgataagaaatgggatcccgatgacgcgttgttagtggagtattattcacttgcagcatggtcgatttcaaacatggttggtggtttgattggtggtgcaatttcgattgaccttgaagtggttgactttgcattaactgccttattcttatatatgatcgtaatgcaagttcaaaatcacttgaccctagttattggcattttggcagctgttcttggtgtatacttccaggcattaactaaaagtacactggggattattattgcgaccttaattgcttcctttgttggattcttgattgaaaatacagttcgtcatcatagtaagcatccaaactcgaactggttcttgacaaaaatgtttaggccgaagatcacaaagactacgatcgaggataagcaagcgcaacaaaaagaagttaaggaagttgaaaaactggaaactaagattgaagatgttgttgaacaccatgataagaaacatgaagagcgaaaacatgatgatcaacatcctgatgagggctagacatggaacaactattaagtaataaaatcgtttaccatattatagtgattatcttggcagctttagcggcatttattccccgttatctaccagtattattcttctcaacgcgaaaaattccagaatggtttaatgaatggatgaaatatgtcccagttagtttatttgcgaccctggttgtaaaagggattttcttaactggctcttatcattttactctatttggttatccagaacggattattgcagcattgatcgtgattgtgattgcgtactttactcgatcaatgtcgatttcagtaattgctggattggttgctgtttggcttctgagtttagcgttataagagtagttttgttataattaaattaagctttaaacagtggattggtttctaacttgcgaaggagccaatcccttttattttaggaagtgagtacgttggattttaagcaaacaattgcatttgttaatcttgctaatactttggattatcaatatgcagcaaaaaaatcagggataacggttgatgaattggttcgcacaattaaggcgcttgaagaagagcttaacgtcaagcttattagacctgaaggcggcgtagttgaattaactgaaatcggggcaaaacttttaccgttgatcactgaaattgctcaaaaacatgctaaattattatcggtagttacggattatcgaaaaaaggaagcggaagaagcgatcaaagttactgtcgtcccaggctttgccaattatcaagcagccccggttgttaaaaaattagcccaacaacataaaatgaatattgttgaagatgttgatccaatggcacagctacaacaaggggaaagcgagctggcatttattagttatgccggcaaacttcccgatgattttgaggtgctttcagtgggaactgatgacttagtagcttatatcccagcgcggaacccactttctgaacaaaaggaattaacgcttactgatctaaaaacagaaaaatttttgacactaaaccatcaaaatccatttgcagtctttgttcaacaggtttgtgctgctgctggatttgacccatattccgtttttgaaggagaaaaaggaagaacattagtaaatatggttgctttgggggatggggataaccttgttgatggaacaatcaataagtgaaaacttagatagtaaagtggttaaagtgccaattgttcccaaagttactcaacaccttgctgttgttcgtcgtaaaaatgtagaacacacgtcagagcaagaagagttatggcaagctctaaaagaatcctttgaaaaatagaaaaaagatttgacattttcacgaactacgcttattatcataaataacaaaaatacctttaacttagtcccgtgaggctaggaaggatttaattgagcgtttaagtacaccttcttagctattgctgagaaggtttttcttttaagcagtagcaccaagaatacgccagtaaaatcaataggtattttgaaacgaccgaccatttaattgtttccagagagagcagaacggtatgttgtttttagcctacttatatcctaaaagcaaacagtgatgactctcgaaatttaaatgggaagttatcactgttttgttgtaattagactggaaaaggagcgctattgatgattagtacagaaagaattcaaccaaatttagtaacagttgccgacatggacgcagcagatgcaattgatttaattcatgaagcccaagcatataaagctgggaagcaagcggttctcactgcaccggcatacgcggttaacctcttctttgaaaactcaacccgaacaaagactagtttccaaatggcacaaatgaagttggggatgaatgtactagaattcgaagcgggcacgagttcagtgaaaaaaggggaaagcctctatgacactgttaagacaatggaatcaatcggtgtaaatgttgcggtaatccgtcatcctgaaaatgaatattacaaccaattgattaatcattcagaccttaagatcggaattgtaaatggtggtgatggtagtggtcaacacccatcccaatgtttacttgatatgatgacaattaatgaagaatttggcgatttcaagggcttaaaagtactaattattggtgatcttagtcactctcgagtagcgcactcaaatgcaatgatgcttaatcgtctaggagcagaggtttattttgctggcccagaaaaatggtatgatcctacactggaacaatatggaacttttggtgactttgacgaattgcttcctcaaatggatgtagttaatttactacgagttcaaaatgaacggctaacgactgctgacggtcaggcttttgatgctaatcaatatcaccaagcttatggtttaactttagagcgggccgcaaagatgaagcagggtgcaatcattatgcatccagcgccagttaaccggggtgttgaaattgatagctcccttgttgaagcgcctaattcccgcattttccaacaaatgacaaacggcgtatatacccggatggcaattcttagtcgagttcttcgttaccaaggattgatgtaaaaaggtgattacgatgagtaaggcaattttactaacgaatggccagcgaatttataatgatgaattggttaagagtgaagttttgattgtagatggcaagattaaggcaattggcgagcatatccaggtaccaagtgatgcagaaaaagttgacctagataatggcttgattacaccgggactaattgatattcatgtccatcttcgcgaaccaggctataccaataaagaaacgattgccacaggaagcaaagccgctgcacatggtggctttacgacgatcgctgcaatggctaacctcaatccgacatgtgatacaccagaaaaatttaaagaacaggttgatcgaaacgagaaagctggactggtaaaaatcctccaatactcaccagttacagttggtcgggctgggaaacaagcagttaatgttgctgagcagtatgctgcaggtgcccgtctttttagcgatgatggtgcgggaattcaagatgctggagttgtataccaagcaatgcaacaactagcgaaagttaacgctccgttatgtgatcatgcgcaagataatcaacttgcacaaaatggggtaattaatgatggggcaactattgctaaaaaactagcactaccaggaatgccagcgattagtgaaacagcgcaaattgctcggaatttggtgattgctcaggcaactggggttcattatcatgtttgccatgtttcaactaaagaaagtattgacctgattcgtcatgccaaacaacaaggaattaacgttacatgtgaagttactcctcatcatttacttttagctgatgctgatattaaagaggatgatgctgaatttaagatgaatccacctcttcggcaacgtcttgaccaacaggcttgtttaattgggctgttagatggcacgattgattgtattgctaccgaccatgcgccacataccgatgcggagaagcaacaaggatttcttaaatcaccaaatggtattgttggctcagaaacagcttttgccttactctatacacactttgttaaaacaggtatctttacgcttgcccaattgattgactggatggccgttaagccgcaagcgatttttaaccttgataacgctggattattaaaggtaggggacccagcagatattgctgtatttgacatcgatcatcaagatgtaattcaaccagaccagtttttctctaagggtcacaatactccatttgttggtgaacaagtatacggaatgactaagcgaacttatgtcgatggaaagctcgtatatctggagggagaaggataatgcaagaaacacaacgattagcagttgaattgccgggattatcactaaaaaatccgattattgcggcaagtgggacttgtggatatgggcaagaagcagctaaaaagtataaccttaatcatttaggctcccttgtgttaaagtccacgaccctttatccccgtcaaggcaatccgcgtccgcgagtttgtgaaaccagtgccggttggcttaatgctaatggtcttcagaatgtgggcattaccgcagcaactaatgaaaaaattccgtggttacgaaaaaattatccgcaactaccgattattgcaagtgctgctggtttttctgaagacgaatacgttaaagtcgttagtgaatttgctaatacggctggggtgaaagcaattgaattaaacgtatcatgtccgaatgtaaaacacggcgggatggcaatgggaactgatccagaagtacttcaacgattagtaaaacaagtagttaaagctgccctaggaattcctatctatgtaaagctaacaccaaatgtaactaatattgttcccctcgcgcaagcagctgagcaagggggcgctaatggcctgacgatgattaatacgttaacaggattaagcatcgacttaaaaacccgacgcccggctttagctaatgtaacgggcggtttatcaggccctgccattaaacctttagcattaagaatgattcaccaggtacgtcaggtttcttctttaccgatcatcggcgtgggtggaattgagtcagctgaagatgttcttgaatttatgatggcgggtgctaatgctgttcaaatcggggcagctagttttcatgatccattggcttgcccgaaaattgcagctgatttaccaatcgtaatggatagatacgggattaagaaacttacggatttatgggaggtaagattttgaaacgcttcgtaccgatggtggctatcgatgttgcaactaagcaggaagcaattgacttatttgacaaattaatggtaaaaccgcagccaatcgtaaaaattggaatggaattatattatggtctaggacaagtaattgttaaagaggcaaaaaagcgaggatttaaggtattccttgatttaaaattatacgatattccaaatactgttcatcgcgcaatggcagctattggtcgattgggaattgattttacgacaattcacgcagctgggggcagtgaaatgctgattgccggattagccggtctagaagaaggagctaaggaagcaggcgttgaaccagcaaagttattagcaattacccaacttacttcgattgatgaaaaaattctgcatgaacaacagcatgttgatttgtcgttgattgagtcagttcaaagctacgcacaactagcagaaaaagtaggattggccggcgtagtatgctcagcccatgaaatcaaggcgattcgtgaagtgactggggatgatttcctatgtgtaacgccaggaatccgcccgactcatgcaataaaagatgaccaaaaacgagtagttacccctgcccaagcaagaatagatggaagtaatgcgattgtggttggacggccaatcacccagagctttgacccagttgctgcttatcaagaagttcaaaaagcattcttaaatgaggaggaagaaaaatgacatattcacaacgcgttgcaaaggcattattagatattcatgctgttacccttaacccagaccaaccatttacctgggcaagtggtctaaaatccccaatctataccgataatcgattgacgatttcttatccagaagttcggcaagcaatttttaatgggatggttgaacaaattaaactccattttagtgcggccgatgttattgccgggacagcaactgctgggattcctcatgcggcatgggttgctcagaatatggaattaccgatgatttatgttcggactaaaccgaaagatcatggtcaaggcaagcaaattgaaggggtgcttaaagaaggacaaaaagtcgtcgtgattgatgaccttatttcaactggtggcagtgtactaaatgctgtgcgggcggttaacaatgcaggcggaaaagtaattggcgttgtttctgtctttacttatgatttgccggctgccgaacaaaactttatggcaaatgggctgaagtactattcagtaacggattatatgactttgattaaggtggccaaggaaaataaccaaattagtacagaccacctcaaatcccttcaagaatggcgaaaagacccgttaagctggagcaaagagcaagcatcataataaattgattatcaaaaaagtctaagattgattcagaaaaatgttaatctgaagtaatcttaggctttatcttattgcttatcttcccaaatcttttggagcattgggtagcgtaagtcaccaacttgtactacttgataatctgcacttgctaatgttttggcatcaccaacaccaattgcaatcgcatttatgtgatgaatattctcgatatcatgagctgtcgttccaactcctatacaattagcgccgataaggtttaattgattaacagcagttagatatgggttttctttatcattagtcttaacgatactatcgacatagttatcaaggccaatttgtttgaggacattttgcacatccccattagtatctaaaacagcaattttaacgtaatgatcatagagatttagtaaaagacgcttaatccctggaagttgatctttttcacttaggctatccgcttcttcgttaagaaatttttgccattctgcaatcattgaagccttttcgctaggggcaagattagcattaaaatgggctaagattagggagagcccttgcgaaggagtaaggttatcaaattgggaagctaattttccaggtaatcccatcccaaattcatacattgcaaaacgttgccaagcagtaaaggataacttatttgtattaacaaagatattattaaacgaaaaaatcgcaccgtccatgattaaacatcccttcataggtaattatgtctatattttaacgtaatcgaaaatgaaagggaatacatttataataacgaacgatataataagggcctccatcacccggttaagccgaacgttggagacccatttgttttttctattttgtcatgtaatcccgagtcattggtaagtttttacctgaaggacccttagtaatcaagtattgaataacatcaatgtttccagattcaaaggatgcagcacatgcttgaagatataaatcccacatccgtgtaaaacgttcacccatcatatcaaggatttgggcacgatgttcattaaagttcatgtcccaaatttcgagggtgcgttgatagtgacggcgaagcatttcgatatcagcgatttgcatatgattttcttcaatgtgaccgatcatttcttcgagaccaggtacgtaaccgccagggaagatatacttgttaatccacccattatatgcaccgccttgttgacgagtaataccatgaatcaaggcaacaccatcatcagcaaggtaaccttggatatctttaaagtaaagacctagattttcttttccaacgtgttcaaacataccaacggatgtaatgtaatcccacttttggtcaccaagttcacgataatcaactagtttaacttcggcaacgtcttgcaaaccttctttttcaatccgttccttaacaaagcgatattgttcttcacttaaagtaaccccggtaacttttaagccatattcttttgcagcggttagcattaatgttccccaaccacatccaatatcaagcaatgttttgccaggctttggatcaagcttctttaagatgtgatgaaccttgtcaacttgggcctttgtaagatcatcgtggttgccatcagtaaagtaagcacatgaataagttagcgtatcatcaagccataacttgtagaagtcgttccctacatcataatgactttgaacatcattttcactttctttttctgagtggccttgtttaggtaaaaatttgcggaacttagaactccgcataaaactatcagcactttcataggctgattcgatcaattcttgaatgctaccctggatctcaatcttcttatccatgtaggcttccccaagtgcaattgaggcgttcttggtaatatcacgcattggaattttttccttaaaagtgatagttacctcgggagttccgtcaccatagataacacttgatccatcccaaaatacgatctttactggaatgttaaacgagtgctttagtagtgacttatagaacgtcttttctaacatgaaacgcatccttctttctgcaataataatattcattataacaccctcaaaataaaagtgtttcaagacaatttataaaaaacatttcataagaaagcgataaactaattgctgaaaaaatgaaagcttgctactatgctaattagtaggaaaaataggggagatgattgaatgacgaatgcctggaagcattttattgagaatgtgaaactacggcgcttcaccgtcttattattaatcattgtcgtactctggttaatgagatcaatgatgaatttaattttatttacgtttattcttacttaccttgttgttagttgggtaagactcgtccagcggtggttaccacgaatgtcgacaagtttaattgtaatcgttacctatgtgttgttaattgttctattgtatttaggagtgacacgctatttaccagttttgtctcggcaagttgttaaaatggttaattcagtagttcatttctatagtacgcatcaagcgacgatgatatatcgttatgtcagccattacgtaagtaccgctactattatgagtcaggttcgacatgggataacaatcgcagttagcactttgacaagtattggtgcaatcactgtttcatttgtaatgtctttaatcttgagttttttctatacgcttgaattaaaacagatgaatgaattttctcatagctttttagatagtgattttggctggtttttccaggatattgattattttggcaagaaatttgtcaatacttttggggttgtattggaggcccaattctttattgctatttgcaatacggtgattaccacgattggcctattatttatgcggatgccacagattttcgccctatcgttgattgtatttatctttagtctggttccggttgctggagtaattatttcaacaatccccttggcgatggttggttactcagtcggtggaattcgcgatgtggtttacattatcatcatgattatcatcatccatactttggaggcctacgtcttaaatcctaagtttatgtctagtcggacagatctaccaatcttttatacttttattgtattgctgattggtgaacatctttttggtacatggggattgattgtgggagtaccaatctttactttcttacttgatgtattaggcgtaaaatccattcgtggtgcaaaaaaaagtaagtaaaaaataaagttccatagcgggattttattttttgctttttggttatccgaacaatatacgttggttagttgaataaagttaacggaaatcgaacttattttgcaaaatagctgaaaaagtcttgagttagtgtataatgaaattaagataggcctaaagaaaggaagctgatatttatgacagacattgagattgcagaccaagcgaccctggaaccaattacagaaattgccgagaaactcggactttcagaagacgaaatcgaacaatatggtaagtacaaagctaaaattgatttaaatgtaaaaccattacctgataaaaaacataaactaattttagttacgtccatcaacccgactcctgctggtgaaggaaagtcgactgtcctcattggcttaggggatgcattaaatcagttaaattatcagacaacgattgcgatgcgtgaaccatcaatgggtcccgtttttggaataaaaggtggtgcaactggtggtggatatagtcaggttgttccaatggaagatattaacctgaactttaccggtgacttacatgcgcttactagtgctaataatacgttggctgctctaattgataactatattatgcgtgataatgcaatgaatcttgatccgcggcgaattatctggaaacgagtagaagacgttaacgatcgtgcgcttcggaatgtagttactggtcttggcggtccaatggctggtgttccacgtgaaacgggcttcgacattacagctgcctccgagttgatggcaattttatgcctttcaactagtctccatgacttgaaagaacggattagccgaattgtagtaggatatacatacgataaagaaccggtcacagttggccagcttaattttcaggatgcaattacaattatcttgaaagacgcattgaagcctaaccttgttcaaactttagaccataccccaactattgttcatggtggcccatttgctaacattgcccatggttgtaatagtgttttggcgacccaaactgcccttaacctttctgattatactgtaacggaggctggttttggggctgaccttggtggagaaaagttccttgatattaaacaacgtgttcttggcaagcatccagatgcaattgtcatcgtagcgactgtccgagcgctagaatacaatggcggtgccaaacttgcagacttaaatgaagaaaatcttgatgcgctgaaaaaaggtatggcaaaccttaatcgtcacattaagaatatgcaattatatgggttaccaatcgtagttgcaatcaatcattttgtcagtgataccgataaagaaatccaaatgattaaggatgattgtgctaagcaaaatgttgaagcgattttgactgatgcttgggctaagggcggtaaaggtacccatgatttggctaataaagtagtcgaacttgctgatagtccaagtgaatttactcatatctatgacgttcaagttgatgaccttcaaactaagttagagaagattgctaagcagatttatggtgctaaagaagtatcatttagccgtaaagcacaaaatcaattgaagcggtttgctaagtatggatggaatgatttgccagtatgtattgccaagacccagtattcatttacagatgaccaaaaacaactaggtgccccaactgactttactttccatattcgggaattggtaccaaagatcggtgccggctttgtcgtggcattagctggtaatatgatgacaatgccaggcctccctaaagaaccagctgctgtaaacatgatgattgacgataatggtaaaattaccggattattctaaataaccaacacaaaacatcgattgtgcaataacgtacatcgatgtttttttcacaaacttttcaaggttagcggattgaagttattgatatactactatgtgaacttaatcgttttcttgtgaaattataaaataaggactacagtagaggtatatcgctttataagtttaattaggtagaggtgaatggctaatggaaaagaaactacatggcgccgatattgttattgatagtttaagaaaacacggggttaatctcgtctttggtattcccggagcgaagattgatcgtttgtttgaaggactagatggtcaagacagtgaagatgcacctaaattaattgttacccggcatgagcaaaatgcggcattcatggcccaagcttatggtcgcttaaccggaaaaacaggggtcgcaatcgctacttctggtccaggggttggtaatttagcaaccggaatcatgaccgctaacgcagaaggagatccaatgttagcgattgggggccaagtacaacggaaggaccttcaccgtgcaacccaccaaagcacgctttcaactgaaattatggcgccaattacgcaatatagcgctgaaattcaagaccctaataatatttcagagattatggccaatgcgtttgaagcaagtcaagatgcacgtaagggagcagctttcgttagtcttccacaagacgttgatgatgctgaggtaactgaaaagccattgccaatttatgaaacacctaagatgggtcctgctgatccaaatgacttacaaaaattagtcgaactaattaaaaatagtaaaatgccggttatcttagtcggtcaacggggcgcggatgaagaaattacgactgctctccgcaaattattaagtgattattcattgcctgttgttgaaacatatcaagcggcgggagtggtatcacgtgacttagaacaacagtcatactttggacggattggccttttccgcaatcaagttggggatcaactccttcaacaaagcgaccttgttattgcggttggttatgatccgattgaatatgaaccacgaaactggaataaggaggggaatctgcgaattgtaaaccttgataccttgccagctcaaattgataaccactatacgccaatcatgcaactggttggtaatattgctacaagcttaacggggcttgataagttactaaaagggtatgagtatcctgttgcagccactgagcaactcgctaagtataagcaagaacttgaccaagataaaaagattcaagtaccaacaagcaatgatgccagtcatccgttagcggttgtgcatgcaattcaagaaaatgttactgatgatatgcacgttgcgctagatgtgggttcccactatatctggatggcacgacatttccgttgctaccaaccacgacacctgttaatcagtaacgggatgcaaacactgggcgttggcttgccatgggcgatggttgcagcgatgctttatcccgaacataaatcagtggcagtttgcggggatggaggcttcctcttctctggggcggaattagcgacagccgttcaacaccatcttaatgttgtaacgattgtatggaatgatggcggtcattacgacatggttaagttccaggaagagatgaagtattcacaagcagctggtgttaaatttggaaatgttgatattgttaagtatgctgagagttttggtgcaactggactgcgggtaaataagccagctgaccttactaaggtactcagtcaagcgtttaatattgacggcccagttgtggtagatgtgccagttgattacagtaataataaagaattagctgccaacttgattgattcacaacttggctaagaggggaacaaagattatgacaacattatatgaacacggaacgttagctgctttgatggcaggaaattttgatggcacaattactgtcggtgatttactaaaacatggttcgatgggaatcgggacttttactggcttagacggtgaggttgttatcctgaataacgaagtgtaccaagcggtttcaaatggtcaggtcaaccacattacagatatggatgctacaatgccattcgcctcagtccattttcccgctgaacaacaggatataacattaagaaatgtaaactttgctaaacttaataatgattttgttaaagaacataagcttgctaatgtttttgcattcttacaattaagcggtgagtttgagcacgttaaaattcgaattgctccgaaacaggaaaaaccatacccgactttactcgatgtcgcgcaacatcaatccgagtttacggctgaaaatatttccggaaccattatcggttattatgcaccagaaatttttggcacgattacggcagaaggctggcatcttcattttattagcgatgatcggcaatttgctgggcacctcctggcatttgatgctccagaattaacaggtagctttgaaatttttgataacctggaacaacatctgccgattcataatcaagaatttcgggagagtacagttgatatggcaactttacgtgatggaattgctaaatcggaaggtaatgctgaatagaacacctaaccatccatccttcgggggtgagactgaaaactcgcaagtgagttcagtctcactctctttctttttgtttattatacacgaactatttattgtttattttatttaaagttcgaatttgtgttgaattacggaagatgatttgctatccttaaagcagatttgaggaggcattgttatgagtgatattagtgtcgtgatgggcagtaaatcagactggccaactgttaaagaaacttgtgatattttagatgaatttggtgtttcatatgaaaagaatgtgatttctgctcatcggatgccaaatgaaatgttcgcgtttgcgcaaaatgcggttgataatggggttaaagtaattattgcatgtgctgggggagcagctcatcttcccggaatgattgcggcaaatacccccctgccagtaattgggatcccaggacagacaaaagctcttggtggcatggactcgcttttatcaattgttcaaatgccagcgggaattccggtggcaaccactgcgattggaaaagcaggcgctaaaaatgcagcgttattagcattgcaaattctggggatcacagataagcatatccaacaacaaatcatcgaatatcgacaggcgatgcatgatcaagcaaaagaaagtgggcagtatcttgaataaatttattccacaaggctcaacgattggcattattggtggtggccaattgggacagatgatggcattggatgccaaacagacggggatgaaggttattattttagatccgacaccaaattgtccagcggggcaggttgctgatgaacaaattgttgctccttatgccgatactaaagcgattgaaaagttagctgataaagcggatgtattaacctacgaatttgaaaatgttgatttaaacgctttggaagatgtacaggatcgcgtttatcttccccagggaactaatttactttacacgaccaaaaatcgtttacgggaaaagaatttcttacgtcaggcaggggtaaaaacagcacctttcatggcagtgcatacttctgctgaattaaaggatgcggtaaagaaaatcggttacccagcagttttgaaaactagtgaagggggatatgacggacacggtcaagaagtgttacgtaataaggatgacctcgataagtgtgcgcctattttagccactggcgactgtatcttagagggctgggttccttttaaccgcgaatgttcagtaatggtcggacgtaatgaagatggagaaataacggcatttccggtttcagaaaatattcaccatgatgaaattctacatttaagcattgttccagcaaggatctcttctgaattacaacaaaaggcgcaaaaaatagcggtgcagattgcccaagcgattaatttgcgaggaattttaggggttgaaatgtttgtaacagatgatggagagatctatattaatgagcttgctccccgtccccacaattctggtcattattcaattgaagcttgtaacttctcccagttcgccatccataatcgagcaatttgtaactggccactcccgcaagtagagctattaaagccggtggtaatggtaaatgttttgggtcagcatgttaatggagtccgacaacagattcagaaaaaggcagattggcattttcatgattatgggaaagcagaagttcgtcataaccggaaaatgggccacgttacaatcttgactgatgatattgaagctactttagcagaaattgacaatacaggaatttggggtgcataaagttcggctttacgtaaccgcttttcttgtgcgataatacatttagaaaaaatagagaggatttttaactgatgattgatcgttataccagtccagagatgaaaaagatttggagcttagaaacacaataccaatgttggttagatgttgagattgctactgatgaagcgtggagtgagcttgggcatattccggcagaagatgtggagaagattaaaaagaatgctaaattttctgtagagggaattgcagagattgaagcagtgacccatcatgatgtgattgcttttacccgtgacgtttctaaatcattggggcctgaacgaaagtgggttcactatggaatgacgagtacagatgtagttgatactgcacaaggcttgcgtttaaaaaaggcgaacgatatccttcgtcaagatattgataactttatggatgtccttaaagaattagctgaaaaatataagtacacagtttgtatgggacgaacacatggtatccatgccgaaccaacgacttttggcttaaaagctgctcggtggtattcagaaatgaagcgtaataaagaacgttttgaacatgctgctaagggtgttgaagcgggtaaaatttctggtgcagtaggaacttttgctgaaattgacccatttgttgaggaatatgtctgcaaaaaacttggcttacgtcctcaagaaatctccacacaagttcttccgcgagatttgcatgctgaatatattgctaccattgcgcttattggaacaagtatggaagaaatggcaaccgagattcgctctcttcaacgaacggaaatccatgaagtcgaagaacactttgccaagggacaaaaaggatcttctgctatgccacataagcgtaatccaattggctcagaaaacattactggttgtgcgcggatgcttcgtggctttatggtacctgcttatgaagatgtttcgctttggcatgaacgggatatttctcattccagtgcagagcgaatgattttaccagatgcaacttcattacttgattacatgttgcggcgttttggtcgaatcttaaagaatctcgatgtattccctgaaacaatgaagaagaatatggataagacattgggcttaatttacagtggtcgggttcttttgaagttggttaacagtggaatgactcgggaagcagcttatgatttgattcaaccatataccgctaagtgctgggcagaacagattccgttccgtccattattggaagatgacccaacaattcaaaagcaattaactaaagaagatcttgatgatgcctttgattaccactggcacctccgccatgttgatgacatttataaacgattgggattagactaatttaagttagtttaaggggctagacgaacaaaaaagtttgtctagcctttttgttatgctttatttatcaaaacacgaacaatttaaacttaaaatcatataaatatcgtaattcgtattgacaagcgggaggaggaaagagtatattgttgtcatgaaatatcgaattaattttcggatattaaaataaatgttcgtgttttactgaaaggaagttccgtaaatggagaagttattgtataccggcaaggcaaagcaaatgtggcaaactgaggatccagcggttttacgagtagtttatctggaccaagctaccgccctcaacggaaaaaagaaggatcactttactggtaagggtaaggctgccaatgctatttcttccctcgtttttgattacttaatgaagcagggaattgagacccactttattaagaaactatcaactaacgaagaccttgtaaaaaaatgtgagatgttcccgcttgaatttgtaacgcggaatgtaattgctggtcattttgcgagtcggtatggactttcagaaggggaagagcttccttcaccagttgaggaaaccttctataaaagcgatgaacttaatgatccctttatcaatgaatccgcaacgattgctcttgagattgccagcaaagaggagcttgcgcaaatgtgggggatctgtcggaaggtcaataacttacttaaaccattatttgccaaagctaatttacggttggttgacttcaaactcgaatttggccgtttaagtgatggcaagattattcttgcagatgaattttcgccagataactgtcggttatgggatctgacaactaagcaacatatggataaagacgtatatcgacgcaaacttgctgatttaacccaaacatatgatggggtattggaacggttagaagcagtgatgaaggaggaagcataaatggtcaatgttcggattttcgtaacatataagcaatcagtctttgatccgcagggagaaacaattaaggatgcgatccattctctaggtcatgatgaagtaactgccgttaaagttgggaaattctttgacgttaccttagacacaaatgaggatgaggtagcaacggcagtaaaagaaattgccgatcagctccttgttaatttcaatatggaaacttatacataccaagttatggaggaagcctagatgaaaattgcggtggttgtttttccgggatccaattgcgatgtggatttatatgaagcccttcattccgtttgccatgcagatgtggagtatgtttctcaccggcaaaaaagtttagctggttttgatgctgtgatgttaccaggaggattttcctatggtgattatctacgagctggcgcaattgctcggtttaccaatatcatgcctgcaataatcaaaatggcaaatgagggaaaaccagtctttggaacgtgtaacggatttcaaattttgacagaagcaggtcttttgccaggtggactcaaacgcaatgatagccaacgctttgtttgtaaaactgttcctttagaagtagtgaactcgcacactctttttactagtcattatcaggatcacgaacgaatcgcattaccaattgcgcatgccgatggtagttattatgcggatgaaaaaacactagatgaacttgaagcaaataatcaggttgtctttcgttacgcgactgaaaatccaaatggcagtttgcataacattgctggaattaccaataagcacggaaatgtcttaggcatgatgccccatcctgaacgggcagtagaaactattcttggtagtacggatggcttacggttatttgaatccttgttagaaaacggcagaattaaagtggaggcatagttaatgaaacaagcaatgaccccagaagagattaaagaaaagaaaccatacttagattggagcttgactgaagcagaatatgattacattcgtacccagctcttaggacgattaccaaattatactgaaactggcttgttttctgcgatgtggagtgagcactgttcatataaaaagtcaaaaccggttctgcgtctcttccctaataaaaatgagcgagtattgcaaggtcccggagaaggagcaggggttgttgatattgatgatggacaagcagtggtattcaaagctgaaagtcacaatcatccgacaactgttgaaccttatcaaggagcggcaactggtgtcggtgggattctacgggacattttcagcatgggtgcacgaccaattgcttcccttgattccctccatttcggtgaattagataattcgacaacgcggatgaaagtaactaataccgttcggggaattggtgattacggtaattgtatgggaattcctacaattgcgggtgaaacaacatttgatccatgctaccagggcaatattctgtgtaatgcaatgagtgtcggcttaatggaccagaaagatatccagcagggtcgcgctgccggaattggaaatgcagtgatgtatgtcggtgctaaaactggccgtgacggaattcatggcgccacctttgcttcagcagactttaatgatgaaaatatgacgcagcgttcggcggttcaagttggtaatccttttatggaaaaactcttattagaagcttgccttgatcttattagaaatcatcctgactggttagtaggaattcaagatatgggggcagcaggaattgtttcttcaagtgcggaaatggcttccgaaggtcaaagtggaatggagctaaatttggatcttgttccgcaacgtgaacccgggatgtcggcttatgaaattatgcttagtgaatcccaagaacgaatgcttctttgcgtaaaaaaaggccatgaagaagatgtcaaaaagatttttgatttttacgatcttgaagcggtcacaattggccggattactgcgggtcatgattatgttctctttcatgatggtgaagaagtatgtcatatcccagtgtcgagtttaacggatgacgtactagaagaagaaagcctagaaaaaaagcctgcgcggattgaattagccgaacagcagccagcgtggattccggatattgataacgttgctgaagttttaactgccttgcttgctcagtcaacgattgcggataaaagtagtctttatcagcaatatgattctcaagtacggacgaatacagtggctggtcccgggagtgatgctggggttctgcggattcgtggaacacataaagggttagcgatgacaactgatgggaacggtcggtttgtttaccttagtccagaagttggtggacaaattgccttagttgaagcggctgccaacataattgccagtggagccgaaccgttagcaattactgactgcttaaattatggtgacccaactgatccagaaattttctgggaacttcatcaatctgtccaagggatggctgatgcttgccgtgaatttaataccccagttatttctgggaatgtttctttatataacgaaaacaatgggcaagcaattcacccgacgccgatggttggaatggtcggcctgattaaaaatattgatcgcgtaattccttcgtttgtccaacacccgggagataaggtttacctagtgggccaaactcgtgatgattatgcggggtctgagttgcaaaaaatgatgaccggtgatattagcggaattgttgaatcatttgaccttcatcatgttcatcaatatatgcaacggttattgacaacgatggagaacggccttgtttccagtgcgcatgatttgagtgaaggtggcctcggagtagctttagcagaaacggtcttcaaaactgatttagggttgaaaattgaccttgctgatcagcacacagctcgcctgtttagtgagactcctggaagatttatcgtgacggttgctcctgaaaaagcaaccgaattcgaacaggtattaggaaaagatgcgcacttaatcggagaagttacgaatagtcactggttaatggttaaactggcaaatggtgaactcaatgaaaatgttgcgaaattacaagaaacatgggaggaggcaattccgtgccaactgaaatcaaaggattaaatgaggaatgtggggtctttggggtttttgatgcggctaacgctagtcaattaacctattacggcctgcatactcttcagcatcgcggccaagaaggagccggcattgtctcaactgatgggacggaactttatcaacaccgtgaccgaggattgttggcgaaagtgtttgctgatccggctgagcttaaacgattaaaaggaaacgctgcgattggccatgtgcgttatgggacaagtggacataattcgattgccaatgttcaacccttcctttttcactttcatgatggtgctgttgcactcgcccacaatggtaatttaactaatgctgttacccttcgtcgtgaattggaaaatgaaggggcagttttccagtcagattctgatacggaaattttaattcaccttatccggaaatatattaatgaaggttttattcctgctttgaagaaaagcctcaaccttgtccatggtggatttgcctacctattactgcaaaaagatcggttgattgcggctttggatcctaatgggattcgtcctttatgtattggaaggttagaaaatggtgcttatgttgttgctagtgagacttgtgctttagatattattagtgctcaatttgtgcgtgatgttttaccaggagaattaatagttattgataaaaatgggttacatattgaccattacactacccaaactcagctggcaatttgctcaatggagtatatctattttgcccgtcctgattctattattcatggggtaacggtacataatgcgcggaaacgaatgggaaagttattagcaaaggaacatccggttgatgctgatatggtgattggagtacctaactcatcgttgtctgctgctagtggatatgctgaagaaagtggccttccatatgaaatggggttaataaagagccaatatgttgcgcgaacgtttattcaaccaactcaagagttacgggagttaggcgttcagatgaaattatcagctgtccgcggagttgtaaaaggaaaaagagtggtagtagtcgacgattcgattgtgcgcggaacaacttctaagcagattgtccaaatgctaaaaagagctggggccaaagaagttcatatgcttatctcctcaccaccatttaagtttccatgtttctatgggattgacgtatcaacgcgttcagaactgatggctgctcattactccattgaagaaatgcggcagttaattggtgcagattctcttaattttttgagtattgatagtctaatcaaagcaattaacgtaccagacgcaggagatgctcctaatggtggacttaccgtggcttattttgatgggaagtacccaacaccactttatgattatgaaaaagggtacttaaagtcgttaagcgaacaagagcgattagcaggaaaggggtaagaggatgagtcgttatcaagatgcaggggtagatgtaaatgccgggtacgaacttgttcaccgtattaaagatgcagtcaaatcaactgatcgcccaggtgtgattgggggaattggcagctttggggggatgtttgacttagaaaaattacaggtgcagcatccaattcttgtctctggtactgacggtgtaggtacgaaactcttaattgctcaacaaatgaataagcacgatacaatcgggatcgatgttgtcgcaatgtgcgttaatgatgtcctggcgcagggagcggaaccaataacatttctcgactatattgcgaccggccataatgatccggctaagatggcagcgattgttagtggagtagcaactggttgccgagaagctggagccgctttaattggtggagaaacagcagagatgccagatatgtatgcagccaatgagtatgacctagcaggaacagtaacagggatagcagaaaaagaagaacttcttaccactgctggaccacaaaaaggtgatatcttgcttggactcccatcaagcggcttgcattccaatggcttttcccttgtccggcagatcttatttaaggataatcacgtcaaattaactgatcgcccagaagcattgagaggaaagacggtaggagaaacgatcctaactcctactaggatttatgttcaagcggttttaccactagtacatcgcaaattggttcatgggattagccatattactggtggaggattgattgaaaatgttccccgaatgttaggagataacttgcaagcggtgattgatcctggtcggtggccacagcttccagtctttgactatttgcgggtgctaggaggccttactaaggaggattgtttcgaagcatttaacatgggaataggaatggtcttagcagtagcaccagatcaagtagcacaagttcaagagatactatcaaataaaaacatgacaagttatcaaattggttatcttcgtcattgtttgccagatacaaaaaagattgttatcaagtgaggggtgtaaatgagagtcgcaattttagcatcaggaaacggaacgaattttgaagtcttagcacagcacttcaaaaataatgatcttcctggtgaattagcattattattctgtaatcatccagatgctccggtaatgaaaagagctgcccgactggggatttcggcagaaagctttacggtcaaatcttgtgggggaaaacaggaatacgaggaaaaattattgggagtgttgaaaaagtatcaaattgactttattgcccttgctggttatttacgagtaattgggcccactattttagatcattatgctcaccgaattattaaccttcatccagcatggttgccagaatatcctggactacattcgattgaacgggcatttgctgatcaacaagcacagacaggcgtcaccgtacactatattgatgcgggactcgattccggccccattatcgcccaggaacacgtcccaattttaccaactgatactattgaaaccttagaagcacgggttcatgaaactgagcaccggttatatcctgaagcactaaagcaggcattagaaaaggagcaacattaaattatgaaaagagcattagtaagcgtttctgataagcaaaacctggttccattcgttaaaggattagttgaaaatggttttgaaattatctcgactggtgggacgaagcgggttttagacgaagcgggaattgaaacaattgggattgaggatgttactcattttccggaaattcttgatggccgcgtaaagactcttaacccatacgtccatgggggactgttggctcgccggaacttaccagaacacatggcaaccctcgaaaaacttaatattacgccaatcgatttagtctgtgttaatctttatccatttaaagagacgatcgaaaagccgggagtggaaatagccgatgcaattgaaaacattgatattggtggtcctagcatggtccgctcagctgctaaaaactatcatgatgtaacaattgtggtggatcaagctgattacgatgaagtcttagcccagatcaaagaagatggtgaaacatcattagcaacccgagcacgcttagcagcaaaagcctttcgtcatacggcagcctatgattccctcatctctcaataccttacaaaacagacagggcttgaagacccagaaaaattaaccttaagctgggatttaaaagaaacaatgcgttatggtgaaaatagtcaccaaaaggcttggttatatgaagacgcgcttcctaaggctttttcagttttacaggctaaacaattacatggtaagaaactttcctacaataatattaaggatgctgatgaagcattacggtgcattcgcgaatttgatgaaccaacagttgtagcgatgaaacatatgaacccatgcggcattggtcgaggagatagtttggttcaagcttgggatcgtgcctatgaagctgaccctgtttctatctttgggggagtgattgctcttaatcgccaagttgatttagttaccgccgagaaaatgcacaaaatctttttagaaattgtcattgcgccaggctttgacgatgatgcatttgagttgttggcaaagaagaaaaacattcgcttactaactctggacttcagtaagaaggatgaaccaactaaacatgaagttgtttcagtgatgggtgggatgttgttgcaggaacaagacatgcttaaggaagattaccacgactggcaatgtgttactgaaaagcaaccaacagaggaacagcttaagacattaatgtttgcttggaaagcagttaaacatgccaaatcaaatgcgattgtcttagcaaatgatgagcggacgttaggggtcggagaaggtcaacctaaccgaattgattcattaaaaattgccgtaaaacatgctggcgaggcgattgatgatcggacagtgatggcatcggatgctttcttcccatttggtgattgtgttgaatatgcgggtcaaaatggcattaaggcgattgttcagccagggggatcagttcgcgatcaggaatcaattgagatggcaaataagtacggaattgcaatggtcacaacaggcattcgtcatttccgccattaaagctaggagggtatcatggaaaagcaggtcaacgtattagttgtaggtgaaggcggtcgtgaatttgccgtggcgaaaaaattacaagaaagtccccgtgttaagcaagtttattgtgcgccaggcaacgtggggatgtcgactgtaggagtggttcccgttgcaattgcggaaactgactttgctaagctgattcaatttgctaaagaacataatgtcgcgtggacattcgtgggccctgaggattgcttggttgatgggattgttgatgaatttaaggccgctggattaaagattttcggtcctgatgcgcgggctgcccaattagaaggttcgaaagactatgcccttaattttatgaataattatcacgttcccactgcccgccatgcgacatatcgggatcaaacagcagcaattaataacgttggccaatttggctttccggtagtaattaaagaaaatggtttagcaggaggaaaaggggttgtcattgcaaaggatcgtgtagaagcaattaagacaatcaaagaaatgtttgtcaatggtcaggcgcgccttgtgattgaagaatgtctatcaggtcctgaatattcaatgtttgttttgattagtaatggtcactatcgaattttgcccatggctcaagaccacaaacgagcatttgatggcgataaaggtcctaatactgggggaatgggggcttatagtcccttgccacaactttcctcagctgttcgtcaacaaatgattgatgaagtacttaaaccaacagttgatggtttggtggctggcgagtatcactaccatgggattttatatattggccttattttgactgacgatggtccaaaagtaattgaatataatgttcgtctaggtgatccagagacccaggtgattttgccccgcatgaaaaccgacttgtttgaacttgtagatgcagcaattaatgatcgaccattaccagaagttgaagaaaatgaagatgcttgttttggcgttgttttggcatcgaaaggatatccaactaagccaatccatggacaaaagctgggaacatttcccgttgatcccaatgtcactattgattatgcaaatgttgctgggacgattaatgacttaagaggggcaggcggacgtttactaatggtgatcgggaaagatgattctcttcaaaaagcccgcgatcacgtttacgactacttgcgccagcttgatgaacctgaatgtttttatcgtcatgatattggtgcaaaagctggactacaataatttcttcatcactattggcatttgcaggggaatggattaaaataatatggtaatgctgtttatagcgattttaagaagaaagaggtcaattgaacatggctaaattagtattaattcgtcacggtcaaagtgaatggaacttatctaaccaatttactggttgggttgatgttgatttaagtgaaaagggtgttgaacaagcaaagaatgctggtaaagcccttaaggaacacggcattgaatttgactacgcatacacttctgttttgaagcgtgctatcaagactttgcactatgctcttgaagaatgtgaccaattatggattcctgaatacaagacttggcgtttaaacgaacgtcactatggtgcacttcaaggccacaacaagcaaaaggccgctgaaaagtacggtgacgaacaagttcacatttggcgtcgttcatacgatgtattacctccattgctaagtgctgacgatgaaggttctgctgcaaaggatcgtcgttacgctaacttagacccacgtgctattcctggtggtgaaaacttaaaggttactttggaacgtgttattccattatggcaagatgaaattgcaccaaagcttttggacaacaaaaacgttatcatcgctgcccacggtaactctcttcgtgcattgagcaagtacatcgaaaacatttctgatgaagatatcatgaaccttgaaatggctactggtcaaccagttgtttacgacttcgatgacaagcttaacgtattaagcaaggaaaagtactaaaataaatttacgatattaaatttggagaggcgggaaagttaaatttctaacgcctcttttttgtagccttttttgaaaaaatattgaagatattggcgaataaattgagcttatagtgagttgtggtatgattaacatcagaatctaataaggtggagagaatttaaatgaaaatggaaaaacaacgaacactcccaatgaaggaatttttcccttcattgaaagaactggtaaagcccaactatttaaaggcaatgtggccagttgcaggggtatcaattatttttattgctttagcagcgattttagcactccttaattcaaacattgctgcctcgttgagtatgacaatgatgatggtaatgtacggaatggcttccccggttgcaatcttgttctcattattagaaattgtagggattgtcgcaattattgctgcgttagctttcttctatactttctttggcgttgctactcaatatacataccaagataagatggctcatccagaacaaccagttagtgctggctcaatctggatgcactataagcacttgcgaaagaatcaagtatggcggatcgtgctttatattggattgttcactttcttatggagtttgcccctcaacattgttaacgcattactcttgccacatctatccggagtagccgctgtttatacggggtgggcaattcgcatccttaatgatattgtcgtattatggaagagtattgaatattctcaatcatacttcctttatcgtgaaaagcagccacaattccttggccaatcaatgcgttatgccttaactgctagtcggcggttcatgactggtcgaaagtggaactactttgtaattttgtttgtcttagaattccttccaatttttatctggactttaatttttggtggattggcattttacggtgtttacacggcaacttatgtccttacttatatcggaatcgtcttagtgattgttggtatttcctgctaccttccagtggtatatgcaattcttgctttatactacaacaaggctcgagcaggaatggaaatggatgtgcttttcaaggatacttttaagccagtagctgaattaaccggtgaagcttatgttcatgaagtatatgtagaaaaacaaccaaaagaacaaccatcaccaactgtgaagcgcgaagacgaaaagaaacacgaagcaaaaaaagatgaatagtgaaaaacgaggctgaagggtaacgaaatctcttcagcttttttgaatcttaaatacttcttgacagtaatcgttaattccatgtacaatgacggcaataaccaaagatgaagaagtaatcttagtagtaagcggttggacatttaggaagcaagtggtaactgtaaactttgccaatgccgttatacgaattacacttacggagtctttcagtatttgaacggatcgtctcgttatcgactagagtggtagctagctagctgcaatcaaggtggtaacgcggtaaatcgtccctgacttcattatttgaagttggggattttttgtatccgagaaacttatggaggtaaacatggatattcttaatgaactagaatggcgtggggctattaaccaagttacagacgaagaaggtctacgcaaattaacatcagaagataaaattgctctttactgtggaactgacccaaccggggatagtcttcatattggacacctaattccatttatgattttgaaacggttccaattagctggtcaccacccagtaattattattgggggaggaacgggtgcaattggtgatccatccggtcgaaagtcagaacggcagcttcaaacaatggatcaagttcaccacaacgaagaagcattaactgctcaaatgaagaagttgtttggaactgaaaacttcacaattgtaaacaactatgaatggttatcaaagatcagtttattagacttccttcgtgactacggtaaactgtttaacattaacaccatgttaaataaggaagtagtagcaagtcggttagatgctggtatttcatttactgagttcacttaccaaattcttcaatcggtcgatttccttcatctttaccgccacaacgatgtgcaattacaaattggtggctccgatcagtggggaaacatcactgccgggattgatttgattcataaggttgaagggccagatactaaggtttacggacttaccattccattaatgctcaaagctgatggaactaaatttggaaagaccgcgggtggtgcaatttggcttgacccagaaaagacttctccatacgaattttatcaattttggattaatcaagatgaccgtgacgttattaaatacttgaagtacttcactttcttatcaaaggaagaaattgatgacttggcagaaaaagttgaaaaagaaccatggaagcgagaagctcaacgtcgcttagcccaagaagtaactaaatttgttcatggccaagaagcagttgaagaagcagaacggattagtaaagcattgttctctggggatgttgctgatctttctgttgcagaaattgaacaaggcttcaagaatatgccttcagtagatgtagaaaataagaaagaaaatattattatttggctaactgataatggtattgaaccttcacgccgccaagctcggcaagatgtatcgagtggggctatcagaattaatggggaaaaagttgatgatgttgacgccgagattgatccccaagcgcattttgctggtaagtttgtgattgtccgtaagggtaagaagcactattacttagctcgcgtaaaataaactagaccaatcgttaggaaatacgttcttaaaagataatttaagggcgtattttttatttttagatgcaaaaaacaaattttacttattcaaaaaataaaaaagttcagttttaaaaaataaattcaaaaagttgaaaaaaggtgttgacgaaagaatgaaatccatgtatagtagttatcgttgtcgaaacagttaagtgctgttgagatggtttaacaaaaaagttaaaaataattgttgacatctgattgacgacatgatatattaataaagttgctgattgagttatcgatcaaaagaaattcaaaattaattaaaatttcttcttgacaagctaatctgatatatgttataataattatgttgattggctgcttgattagccaacaggtagacctttgaaaactgaacaaagtttcgacgaatcaaatgtgtagggtcttcaatcacgatgtgatttgaagcaaaacatttgcgaagtcaattcgcttaataacaaagataattgagagctattcaagttcttatatattttatatgagagtttgatcctggctcaggatgaacgccggcggtgtgcctaatacatgcaagtcgtacgcactggcccaactgattgatggtgcttgcacctgattgacgatggatcaccagtgagtggcggacgggtgagtaacacgtaggtaacctgccccggagcgggggataacatttggaaacagatgctaataccgcataacaacaaaagccacatggcttttgtttgaaagatggctttggctatcactctgggatggacctgcggtgcattagctagttggtaaggtaatggcttaccaaggcgatgatgcatagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaagctctgttgttggagaagaacgtgcgtgagagtaactgttcacgcagtgacggtatccaaccagaaagtcacggctaactacgtgccagcagccgcggtaatacgtaggtggcaagcgttatccggatttattgggcgtaaagcgagcgcaggcggttgcttaggtctgatgtgaaagccttcggcttaaccgaagaagtgcatcggaaaccgggcgacttgagtgcagaagaggacagtggaactccatgtgtagcggtggaatgcgtagatatatggaagaacaccagtggcgaaggcggctgtctggtctgcaactgacgctgaggctcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgctaaccttagagataaggcgttcccttcagggacgcaatgacaggtggtgcatggtcgtcgtcagctcgtgtcgtgagatgttgggttaagtcccgcaacgagcgcaacccttgttactagttgccagcattgagttgggcactctagtgagactgccggtgacaaaccggaggaaggtggggacgacgtcagatcatcatgccccttatgacctgggctacacacgtgctacaatggacggtacaacgagtcgcaaactcgcgagagtaagctaatctcttaaagccgttctcagttcggactgtaggctgcaactcgcctacacgaagtcggaatcgctagtaatcgcggatcagcatgccgcggtgaatacgttcccgggccttgtacacaccgcccgtcacaccatgggagtttgtaacgcccaaagtcggtggcctaacctttatggagggagccgcctaaggcgggacagatgactggggtgaagtcgtaacaaggtagccgtaggagaacctgcggctggatcacctcctttctaaggaataaaacggaacctacacatcgaagaaactttgtttagttttgagaggtttacctcttaaaactttaacctataagacgcttatttgggcctatagctcagctggtttagagcgcacgcctgataagcgtgaggtcgatggttcaagtccatttaggcccatatggggaattagctcagctgggagagcacctgctttgcaagcaggaggtcatcggttcgattccgttattctccattatcaaccataaggttgatagagtttgtactttgaaaactaaatactatctaatttctttattaacaaaacaataaaccgagaacaccgcgttatttgagttttaattaacgaattataatcgctaactcaattaatcagacaatctttgattgtttaggttaagttatgaagggcgcatggtgaatgccttggtactaggagccgatgaaggacgggactaacaccgatatgcttcggggagcggtaagtacgctttgatccggagatttccgaatggggcaacccaatcagcttagtcgctgattacttgactagtgaatacatagctagcaagaggtagacgcagtgaactgaaacatcttagtagctgcaggaagagaaagaaacatcgattccctgagtagcggcgagcgaaaagggaagagcccaaaccaacaagcttgcttgttggggttgtaggactgaacattagagttaccaaagtgcgacgtagtcgcaacagttgggaagctgtgccatagagggtgaaagccccgtagacgaaacgtcacactctctgttcaggatcctgagtacggcgggacacgtgaaaccccgtcggaacccgcgaggaccatctcgcaaggctaaatactccctagtgaccgatagtgaaccagtaccgtgagggaaaggtgaaaagcaccccggaaggggagtgaaatagttcctgaaaccatgtgcctacaagctgtcggagcccgttaatgggtgacggcgtgcctcttgcagaatgaaccggcgagttacgattgcatgcaaggttaaggtggaaaaaccggagccgtagcgaaagcgagtcttaaatgggcgtaaaaagtatgtagttgtagacccgaaaccaggtgacctacccatgtccaggttgaaggtgcggtaaagcgcactggaggaccgaacccgtgtcagttgaaaatggctgggatgaggtgtgggtagcggtgaaattccaaacgaacttggagatagctggttctctccgaaatctctttagggggagccttgaggtaaagaatcgtggaggtagagctactgtttggacaaggggcccgtcatgggttaccaacttcagataaactccgaatgccatcgatttatactcaggagtcagacgatgagtgataagatccaccgtcgaaaggggaacagcccagatcaccagttaaggtccctaaatatatgctaagtggaaaaggatgtggagttgcatagacaactaggatgttggcttagaagcagccaccatttaaagagtgcgtaatagctcactagtcgagtgatcctgcgccgaaaatgtaccggggctaagcatattaccgaaactgtggatgtgcactatgtgcacgtgataggagagcgttctaagggcggcgaagtcagaccgtgaggactggtggagcgcttagaagtgagaatgccggtatgagtagcgaaagacaggtgagaatcctgtccaccgaatgactaaggtttcctggggaaggctcgtcctcccagggtaagtcgggacctaagccgaggccgagaggcgtaggcgatggataacaggttgagattcctgtaccagttaactgcgtttgacgatggagggacgcaggaggctaagcaaaccgtacgactggaagagtacggccaagcagtaagtcaggatgtgagtcaaatgtttacatccgtgttgacaagctgtgatggggagcgaaattaaagtagcgaagttgccgatgtcacactgccgagaaaagcttctaaggagtagttaactgcccgtaccgcaaaccgacacaggtagtcgaggagagaatcctaaggtgagcgagagaactctcgttaaggaactcggcaaaatgaccccgtaacttcgggagaaggggtgctggccgcaaggccagccgcagtgaataggcccaggcgactgtttatcaaaaacacaggtttctgcaaaatcgtaagatgaagtataggggctgacgcctgcccggtgctggaaggttaaaaggatgggttagcttcggcgaagctcagaattgaagccccagtaaacggcggccgtaactataacggtcctaaggtagcgaaattccttgtcgggtaagttccgacccgcacgaaaggcgtaacgatctgggcgctgtctcaacgagagactcggtgaaattgaaatccctgtgaagatgcagggtacccgcgacaggacggaaagaccccatggagctttactgtagcttgatattgagtgtttgtactgcttgtacaggataggtaggagccgtagaagtcgggacgctagtttcgacagaggcgctggtgggatactacccttgcaatatgaccactctaacccgcagcactgaacgtgctgggagacagtgtcaggtgggcagtttgactggggcggtcgcctcctaaaaggtaacggaggcgcccaaaggttcgctcagtatggttggaaatcatgcgcagagtgtaaaggcacaagcgagcttgactgcgagacagacaggtcgagcagggacgaaagtcgggcttagtgatccggtggttccgtatggaagggccatcgctcaacggataaaagctaccctggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgtaggaaatttgagaggacctgtccttagtacgagaggaccgggatggacataccgctggtgtaccagttgttccgccaggagcaccgctgggtagctatgtatggacgagataaacgctgaaagcatctaagtgtgaaactcgcctcgagatgagatttcccatttccttcgggaaagtaagacccctcagagatgatgaggtagataggatggaagtggaagtgccgtgaggcatggagcggaccattactaatcggtcgaggacttaaccaaggagcggtaaggtttattggaagagaatagatagtatttagttttgagagcataagctctcgtccgaagggacaaagagtgtggtgatgatggcttgaaggatacacctgttcccatgccgaacacagaagttaagcttcaacacgccgaaagtagttgggggatcgctccctgcgaggataggacgttgccatgcgatcaaaacgtgaaccggttaaacgattcgcgtcttttctttaataacattttctggtataattaattaggaattgttattatgctgacttagctcagttggcagagcacgtcactagtaatgatgaggtcggaggttcgaatcctctagtcagcatatctaaacttaacaaagtttaatactccttgatatatcaatacttttcaaaggtatatcaaggagtatttttgtttttaaactaaaaaagagggtaagcagtcgtaagcagtccatattgacacgtctagccatcaaaaacttagtcttctatactaaaagcaatcttagtacaggaggctttttcttatggaaggaaaacacgatattgtatcaccaatttttaagcccaagaattcagttgttaataaggatgaatttattcctcggccagccgcaaaactacaagttgataacattgaattaacgatctttaagggagctaatctcagtcttgcgactgatatagctaaagtggttattcgttatgctcattaattggcagacaccggagcatgtttaccttgtttgcggtaaaacagacctccgtaaaggaattgacggtttagcgatggtagttgcggagaactttggactggagttatataataattcgctttttttattttgtggtagtcgcaacgatcggttcaaagccctttattgggatgacgaaggcttcattctgctatataaaagatatgagaatgggagtttaagatggcctaagaacaaaagtgaagttaaagaactaaagccagcgcaactaaatgccttatttacaggtctatccccattccccgagcgaagcattcataaaattaaaccaggaagtttatattaagctctttttaaactgttttggctctgatataataacaaaagtttattagatcggaggtgacgtacaatgactgaatcattaaagaaacaaaacgaagcactacgtgcgcagttgaagaaagcgcaagaacaacttgaacgacaagcagctacgattaagcaactgcaggaaataatttttggaaaaaaaactgaagttttagagcaggtagctgatggacaactatcactatttgatccagttgatgatctgaacttggatcaagagattactgaagtagttaaaacaactacgactaaggtcgtacgtcatcgaccagcaaagaagcaactaactcgtcaagagtttttagaccaacttcctcaagtcgaggaagttgtttctttaaaaacgactgcctgtccagattgtcagcacaaaatggctcatattggaaaacgattggcacgacgggaagctagactaaaagagcccgaattgtattgtgccaacttatatgaggaaagctataagtgtaaacactgtagtcaagatgaaaatgataaattggtaactagtaaggcgcccatggctttattaccacatagttacttttcaagcagtactatggcattcatcgcctatttaaaatttaatctggcgttgcctttccatcggcaagaaggttttgtacaagggctgggattacctgttagtgccaagcaaatggcctcgaatattattaaagttagtcaaacgtacttagagccgttgtatcagtatttaagcaatataattagacaagaaccagtcattcatatggatgaaacaccttttaaagtcgttgatagtcctaaatcccaagactatttctgggtaacgcggacaacgaaagagtttgcccaacatccggttgtagtctttcatcatgccaatacgcgttctggtagaatcattggacaaatagtcggtaataattatccgggtattatcatgtgcgatgggtataaagggtatagtaatcaactctatccgcaagcaaaatttggttcgtgcttagtgcatattcggcgagagtttgtcaaactggttaaggcacttcccaaaacaatgaaggcgtccaaagcgcaacaagcaataactcttcttagtcaggttttccattcggaaaaccagttgagttatcaaacggctaatgagaagttagtgcaacggcaaatccatgtcaaaccgctaatggataaattttacaattacattagccagattagccagccgattggacagttgcgtaaggcaattcagaacgccatccagttaaaatcacgagtgtatcgtgtatttgaaaatggacaattaccgttaagcaacaattcagttgagcaaagtattcggccatcaacactaattcgaaagaattgtctattcgcaaaaaccgaagaaggtgccaaggcgaacgccgtctactatagcttagtagaaacagctaaactaaaccagcttaacgtccagcggtacttaaaatacttgtttgatcacctaccagagagcaattgtcaagatctggcagcttttttgccgtggtcaaaaagcgtacaagaagaatgtcacgaatagaaaatccccgtgaagccatcaaggacgattctacggggattttttgtctgtcaataatgtgtcaatatggactgcttacaagcagtcaataacagtaagcagtcaataacagtatgtctagccctggctaccccggatctcctatactgagactatcatcagtaaggagatttttatgtatgacaaaacaaaatgaaattattaccccggttttcaaaaataaagcaagtgattttaagaagcatgtttttacggcacgccctgctataaaaatcaatgtaaatgaagttgaattgtaagcagtcaataacagtacggattgaaaaaattgggatcatgagctaccgacgtttgcgaaaaggtgattctgcggagcagaaacaagctcggcgccttaaacgttattggcggctatttcttcaagatcgggaaaatttaagtacaaaagtttattacgaaggacgttattttaatcgcgttgttaattccattatgatcttagacttaatattagcgtatgaccaagagttaagagccacctataattttattcaatccttgaagcatgcttacaatcaacgtgattttacaactttctttcaattacttaaactccggccagacagtgtcagccattatacaatccaccgttgtcaagctttagcgcgctataaagagggaattaaacgtggctttgagacgaagttctcaaatggtcgaaccgaagggattaataatcgaattaaaactatcaaacgagttgcctgtggttatcgttactttacggcatttaaaacgcggatttatttaattattggccaccaaattcaaactaactaaaaagaactgtcacgaatgacgattctaactaaaccaatttaattggcgaaaattcatatttgagtatcaacactacttgacgtagagccaaaaaagtgtgtgcataagcttgcatcaggaaaagattgtatctactgatttaataggctttgtgcctatttttttgtgtgcaaacgtataaataaaacgatgttaaagacatagaaaaaaatcaatgacgttatttatgagtattgctgcgtggttgttttggctagtttaaactgttgaattctcacgtttgattattgaaaacaatgattaccgacgacagttgatcttccattttggccggtgcagcgacgaaatcgtaaattactaaaataaatggatcgttcaataactcgctgtctacggcatgataccgtgatgttttatcggtggaagtacaaaattaaaagttaatggatttatatccgctacatgacaaacatgttttaattcttcggctgttgatttaaccatcattatgatttcggcattagctgaatcgctgagttgagggacggcgtttagaaaagtgtatttgttaatcccgaaatgtcaatttaaattagaaaaaagttgaaagctgttcttctgtgacataactcatgaatacttctagtggtgtacgataattaagagactttcgtgggatattgttgcgacggtgcattagctgagtgactagttcgtttggtaaatggcgaaaatctagctttttgctaagaccgtcacgacgcaagatgccgttattattttcgtttaaccctcgttgattgggagcaccgacttccgcaaaataggtatgaagatcatacttattggctatctctcgccatccagcaaattctttcccattatcaaaagtaattgatttaacaaagtgacgtggcagtttagcgagccattggtcaagctggcaattcactgcttcgtctgttttatgatgaatattaaggacaatcattactttggattgtcgctctactagcgtcattaccgctccgcggtgagctttaccttgaactgtatcagcttcaaagtgtccaaattcatgttggtaatgcggaaaatcacgatatcgttgatagatactgcgtcctaattggccagctttaccacgatgttccacatagccattgggatggcgttttcctttcatcggtagctgtttaacggaaaagccatactgattgcgggcaaacatgcgatagagggtgcgcatactgcaactaatcgggtgttcatgacgaccaataatagtatcaggagtccaaccagccttgatttgtgcatggatatagttaacctcgatagttggcagttgggtctgcttccgaccacaacgacgtttatgacgctgataagtctgaagatattggtcgatggttttaccgttattgaggaaacgataaacacgatagatggtttcttgactacgttgaagtaatttagcggcccgataagctttagtgccttgataccaaaaatcagctatgagagttaattcgcgtgtggtaagatgtttataggtcatttgtgattgcctttcttttgattagggatactcaaaagtctatcacaaatggctttttattttttctaacttaattttacaaacggcgaatcataaaactaccttgtaacaattatttttaatttatcatgaatgaacagatgccgatttttttattgcaattttggattgcgctataatatttgatgaggtgaaaaagatggttgacaaaattgttgcacgaccgctaattacgattgcaaatattatctggagctttaatccgcaaacgcacttgccccaaatcctgcttgtaaaacgggcatatgcaccttttaaggatcggtgggcactcccggaaactctattacggagcaatgaaagcgccaaaattgcttgcattcgtttgattaaggataaaattggggttcagctttccaatagtgcgaccgaacaattagcaacatttactaatccccagcgggttagtggcgaccgcgcgttggcgattgcttacatgacatttttaccagtgatgccccagcttaaagccggatacggggcgacagaagtgcggtggtttagtctcaattttgaccatggtgacttcctgctgcaaaacggcgaacttgtcttggggttatccgacgattcaccgttagcatttgaccatcaccaaattattgggactgcaattaggcgcattaaaaataaattaaactatcagccgacgattctccagatcctggggccaacctttactttacgccaggcacgagaagtctatgcgatctttttacaaacaacggtcgagaaaattgataattctaactttaagaaaacccatcgaaaaatatttaaggaggttggaacggctgctactaagcgttcgggacggccgcctaagctatttaaactggcggagggttgtatttaaaaatagcggtgctataatcggaataataaaagttaatcatacttttattttttactataatttaggtactttttacttaaaagattggaagcaaatattagatgaatcatgaattattaaccgatatgtacgaattttcgatggcaaatggttattatctaacgctttctcatgataaacaggctcggtttgatgtcttttaccggaaggctcctgatgatggcagctttgtcatcagtgctggattaaagcaggtagttgatgaagttaagaactggcacttttctcctgatgatattgcttacttgaaatcattgaagcatttttcagatgactttcttttttacttaactgaagctcacaatcggtgctccattgaagcattaccggaagggacgccggttttcccgcaagaaccgtttctaagtattactggtcccttgatggacgttcaattgctcgagacgcttattttaaacatcattaatcaccagtcgttgattgcaacaaaggcatggcaaatcacaagtgccgcggacaatcggccagtaatggaatttggtgcgcggcgggcgcaaggacctgatgccgcaatctacggagcacgggctgcaatcattggtggttgtggaagcacctccaatgttctcgcagctaaactgtttaatgtgccagcagtcgggacaatggctcacgcctggatcgaaagttttcctgatgaattgaccgcctttcgggcatgggcaaaaatttatcctgataatgcggcgttgctggttgatacttacgatgttttgcaatctggggtgccaaacgcaattaaggtatttaaggaattacgggctgcagggcatgaaccagtcggcatccgcattgattcaggggacattgcccaactagcaaagcaggcccggaagatgatggatgatgcagggttccctgatgcgaagatcactgcctcgaatgctctcgatgctcatattatcaagtcgctattaaatcaaggtgctccactggacaactttggaattggggaaagattgataacgagttcatctagtcctgttttgagtggggtctataagatggcggcgcttgaaaataaaggtaagtgggagcccaaaatcaagatcagtaatagtcgagaaaaggtaacgctgccgggacataagcaggtttaccgcttatacgataagcatgatccccagcatgccgttgcggatgtgattgccctggctgatgaacagattgggtccaagattacggcaatcagtgccgacgttcatgtgacccggaacaaggttattttgactgactttattgctaagccgttactgcagcaagtgttaacgcctgataagacggcgacatgcgaagctaatccctttgtaattcaacggtttgcgaagaagaatttagcacagttgccggcagcaacccaacgcttgctcaatcctgaccacttccctgtttacctaacgaagcgtcttgttgatttacaacaaaaattaattgatgaagctaccaatatgtaagagaggtaagaaatgatggcaaaagcattattgataattgattatacttatgattctgttgcagatgacggtgcactaacatgcggtaagccggcgcaaaagcttgagaatagtctcgttgaattggccgataaattttatcgggcaggggattatgtaatcttcccaaccgatgggcatacgggggataagttcagcccggaatataagctatacctccggcacaatattgttgggacgtcaggacagttactatatggcgagttaaaggagtggtatgaccagcactgcgatagcgaccgggtataccagttcaataagaatcgttattccgcttttcagaatactaatctcgataattatttacgtgaacgaaaaattgatgacttgtggcttgccggcttgtgtactgatatttgtgttcttcatacggccatttctgcctataatttgaattaccatcttactattccgaggaaagacgttgcaaccttcactaataatggtcaacagtgggcgctggatcattttaagaattcattaggggcaaccttggtttaatgaattttgaccggaaagaatagacaaatttttatgcaatagttaaagtatagtttacttaaatattgtgatcccttgggcaaacgtggaagctgacaataaaggtagaacgtccaagtaatcgtaattaaaagtagctcttgtcacagttaagtgatgcagtaggaagggctagccatcctaaacacctattggttgaattttcagaaaattaataaaaatatgattggctatcaaaagtctactatgatacatggtacagtgtgtaaacgttgatatatcaagatattctacacttgaatacgaatataaggcaattgcttcgacaacactattaagaatgtcagccgttgctgttgatgaagaagaaacattatgaaaaggccaaagacacatatagcaattttgctgaattcgatttaacgcttggtgcgtggggagtttttatgcgagataaagataaaattttaggagcattatatggacaagcaattggtgattcaatgggaatgcctactgaattatggccaattcaaaaaattcgggataagtttggccggaatattacaacctttttagatggtacagacgataatgatattgcgattaattttaaggctggtgagtacaccgatgataccaaccaagcgtttgcaatcttagatgcgcttattgaaacaaactgggaaccagatactaaagtactagttaagcacattatgaagtgggctgacgctgttggagtatggaccaataatattttaggtccaagtagtaaagcagcactcaaactggtaaaggaagggaagaacccatctgaagttaccaaaactgctttaactaatggttgtggtatgcggatttcaccaattggtactctttatgaacctgaagactttgatcagttaattgagatggtttatgaggttactaagattactcactctagtgatgtttccatttcaggagctgcaatgattgcaggagctgttactgctgcaatggctgactacgactgggatgacattattgattatgctaaaaaggcaaacgatgctggttttaaattaggtacgccaacgtgggctgcacataacaaagaacggcttgaagtcgggattgcccttgcacataagtacgaaggtaatgatgaagcatttagtcgagcaatttccaatactgttggaacaggaaccacgatttcagagagtattccagcagcactggcaattgcttactatgctaaggacgtaaagaagagtgccttcatttgtactaatttaggtggcgataccgatacgattggcgcaatggcaactgcaatttgtggagcaaaagttggtgctaaaaacattccagaagactggaaaaagttaattgacgaaaagaaccctcaacacaatattcaagagtttgcagataagatttctgaatttaaggcatagtaaaatgaggtgaattactatggataatgaatttgttaaagttccagaaaaagataaaacgttaagtcctgggaaacttttctataactggtttgctgctaatatcggtattatgggtttcgtttatggtgctattattgttagttatcatttatccttctggcaatcagttacggcagcgttgattggtgcattgacttttgcaattccgggttgggttgcaatgattgggcaacgtgaaggtgtaaccacatttaagatgagtcgagcaacttttggtacgcatggtaacaaaattcctaactttatggcttggctaaatatggttggctggcttgctgtcaatgtaattactggtactttactattttctgcaatgctaaaaacaatccatgtcccacaaactggctttacaaagtttatttgtttagttgttttcgcaggattagtctttctgtcaggtatctttaaggaagatactttagctaaaattcagacttggttaagctggatatttggtggattaacattagttatgttgattatgttcttaatgaacgcaaattggggtgaggcatttgctatgaagccgggcagttgggtaacaggctggttaccagctgttgccttcattgctgccggttctagtatctcatggtcaatggctgcagctgattggggtgcatacgttcatcctaacacgaagccatctgctactttttggaatactactttaggtgctgctacaccacttttcattttaatggctggtggggtattgctaagtacaatttccccaagtttagctagtgcaagtgacccataccaagtaatgtatggagttattccaggttggtttggttttctctacttcttagtggctgctggtggtattattccacaatgtttagtttcattccgttcagcgcgaatcaatctttctacgattggaattgaagtttcacaaaagagatcattaattttgcatgctgtgattattattctaatttctatctatgttttgtttatttctggtgactttttaagcaactttgaattgttcttaaacttcttgggcatttgccttgcttcatgggttgctatcttcttagtagatagcgttatttaccgtaagaatggctatgatgttaagctaatggaaccaaattcatctgtacactataactggccaggaattatttcttggattattgctactattttcggcttcctctttacgtcaaatgcagcatatcgtggaccgtttgctcatggtatttttgaaaataacagtagtttggctgtcttcgtttcaggaattgctgcaattattgttatgtttattaagagtagtgataagcaggaggattgagtattatgaccaaaaaaagtctaattattggtgctgcttttgtagatgtaataatggacgttccgcagatgccgacttcgggcagtgacgttacagcaaaattaaagtcctataatgttggtggttgtgctttcaatgtctacggtgcaattaaacactatctaggtgctaactctgctgacctctttgtgcctgtgggaaagggacaatatagtgaaatagttcgaaaaacaatgaattatagcagaattccaattttacttgaagataaccatcaagataacggttgggatctttgcttggttgagccaaatggtgagcggactttcatcacggttccaggaattgaacaagattggaaagatgagtggtttagtaagattaatttgtctgattataagtatttctatgtaagtggttatgaaatggaagacgtaaaatcagccaatttactgttggactacttggaacaacgtgataatgattcatacattctgtttgacgcttcaccacgaattagtcatattgattcccggattttaaataggctaatcacaaaaggcgtaattattaatgccaatgaggatgaaattggttttcttagtgatagagatacattggaagaaaagacaagtgacgtttttgaaaaaactgacgaaccagttctcgttactctaggtgctaagggaacttacttatatgatgataatggtggaagaatcattagcagtgataaagtcgaaaatgttgtcaatacaatcggtgctggtgatactcactgtggtggagtgattgctggactgctaaatggtaattcatttgcagaagtatgtaagattggaaataatctttctgcacaagttattcagcaagaagctggaagccttatctaatagtttttgttattacataaattgaataacaggtaaaacagagtacgtaggctataatgctgcctttttaatcagtgatcaaaatgcaacaactacaaaagatgcagtttatcagggtaatgatgttatgaaatttaaggataaatggggaataaccggtgctctgacttctcaaatagatgaattactttacaaacggcgaattaaaaataaagtatgtcgttttagtgaactacaaaaacgaatgccgaattgttctaggcgaatgctatctttacaacttagcgaattagaaaaagataacattgtcgaaaagaaactatatccagttattcctcctaaaacagaatataaattaacccgttttggataaacgttaactccacttattattgaaatggagaaatggggaagaatatataacactataaatttagaataaaattaaaaaatggtgtgaaattttattgatttctaattatagctatgataagattttactattaattaagacgaaagcgagaacagattaatgtcatttactactaatgtacacgtaaatattattattattcggatcattaattagatgatgcgaataattagtgctgttcgcatcaccatactagggatgtgaacagtgatagtggtagagacatttctgtcagccagttgactgttcaacagttagctggtttttttattgaagggatgtgaaaaaaatggaaagtgaaattaagactagaagtgataatagatcgtaaattaaactgaaatgagaggtaaatactatggatagtacagtaactaacaccccgcagacaaacagcaagcttaatgtaaaacgtgatcctgtcaagacagtaattttggcttcgatgatgggaacggcaattgagtttttcgatttttacgcttacgggactgcatctgctgcttattttcccaaaattttctttccgcaaatgacccctttacttgcaacacttttaagtttgttaacttttggagtagcctttgtagcacgcccgataggttccttcctatttggacattatggtgatcgtttaggacgcaagaaaacacttgtggtctcacttttagtaatgggagtggcgacggtagccattggtttcattcctagctatcaggttatcggcgtttggggagcattgttactttgcctttgtcggtttgtccaaggaatcgggcttggtggtgaatggtccggggctgtattagtagctactgaaaatgctccggctaataagcgggcattatatggtgcatttccggaagtgggagcaccaattggattcttcctatgcaatggcttattctttgctttagaacgggtactaacaccaacgcaaatgatgacgtttggttggcgaattcctttttgggcctcagctgttttagtcgttatagggttatatgtccgacgtcgtttacaggaaacacctttgtttaaattagctcaagaacgtgataacacagctgcttcgcctcttcgtgaagtattcaaatctaattggcgtgaaatcttaaaaggaactttcatcatgggagcaacctatgcactattctttacattaacaacttggtcattatcatatgctacaacagctttaggttttacctcttcggaatttttattattattaatgggtgcaattgttgaattcgctgctttgatcatgttaacttctgtattagcagatcgtgttggtcggaaaaaagttctattaactgcgtcagtagcactagttggctattccttggtattcccatatttccttacaggacaacataacttagttggcgttttactcttcttaggactaggattcttagtaatgggcactctttatggtccagtcggtgctgttttgcctgaactgttcccaaccagagttcgctattctggtgcaggaattacttataacttagctgcagtggttggggcagccgttgctccaactgtaacaacgtggttaattgctaattatggattacattcggctggatattatatgctagttttatcagtactagcagttatttcttggttattgacaaaagaaacaaaggatgtggattatactaaataatatcttgtttagaggaattagtgagaaaacctactgactatagttattagataaaaatttatgtccccgttaaaaaagatgatgcaaaaactttggtcaagtcataattaataaagccactggtaacacacattaagtgctactagtggctttattatttacattggttgtccagttgagatttcaaagccggctgttacaggaattacttctcccgtaattgcgctagcagctgggctggcaacgaaataaattgcagcggcgacttcttctggttcaacaatccgatttaacgggctgttcttagcgaatttttgtttatcttggtgaaaaagcggggtattagtcggaccaggtgcaacaacatttacgcgaatattatttttaccgtaatcaattgccattgcccgagtcatgttaataattgctcccttggcggcattataagcaaccattgctcgatcaccagccattcctgagacagaggaaatattaacgatactaccatgatcttgttcaatcattgttggcaagaaggctttgctaacgaggaaagttcccttaacatcaacattaaagattttatcccaatcttcttcactggtttcatgaacctcgccgtgaataacgattcctgcattattgataatcgcatcaacggttttaaatttattgagggttatttgcttaacatgttcaacctcacttgatttactaatatcggcttgaataaaagcaacttgtgccggagaatacgtttcgcctaattgttgttcaacctgcatccccttttctgcatcacgaccgataagcaccgtattccactcgtttttaagaaaaatattagcagtggcaagaccaatcccagaggttccaccagtaataacaactgtttgcatatataaaactcctctctaatcttttctctaattatggcatttttggccgaatttagctatttgttaggaaagtctttataataaaataaagatgaggaggaaacgcaatgaatacagcaaccttaaaagcgctccaaaattggcttcatggacgtggctatacattagaacaagtagacgcacaactaattcttaaatatcatggacaagaacgagcagtcattacgccacctgatcgctatcaagtgaaagaccttgacctgaattttaatgaatgggttgagtttaataaatgcattcggaatattcgccattatttagctagtaacgaataggaagccttttctttggcaagaatacttcctcgtgatagagttattcatgaagggaatatagtccaaggagggatagtcatgataagagttggaataattggtgcttctggaatggcaggtagcgcaatctataaattagcatcgacgaaaaaagatttgaatgtaactggaattgttcgaaatgagagtaaggctagaaagattctcggtgccgatgctaatttgatcagtggtgacatttttgccttaaatgatagtttgttgtcgcggtttgatgtgattgttgatgcatatggtactagtccggaaaatgctgatcggcaagtaagactagctgagaaattagtagttttagcccggaaacataaaatccgtttaattttcattcttggtgccggaagccttaaaactggtaaggataagcacctatttgttgatgatattgaaaagatgcctggtgctgagacatggattaataccccacgccagcagttaaaagagttacagtatcttgaaactatttctgacattgattggttaggtatttcaccatcagcagtatttgaagctggggttgctactaattatattcttggtcaagatgaattattatttaacgaacaaaatgaatcaaaggtaactgctggaacaatggcgaagttagtggtcaatgaaattttagcgccacgccaccatcgtgaacgaattactgttattgatgcagaatagttattggaactaaagcaaatacgaaaaggcatgagaacgcaaatcaattctcatgccttttaatattagtcaactaattttccgataattggaagttttgaaaccggtgaatactttttagctgcttgttgataggtgacatctgataaatcatggccgaaaacattaccgtggatttctgcgcctttccactctggaacctcagaaacatcataaacatttccacgcactccaatatatgccggacgaccttcttgaccattatattgcgctaattcattgtgagtaaatgaccgcataataatccctcctataagaagctgggaattgactcggccccttcctgtatagatgtaataacatatgaaaatagatgacgagtttattcgttatcctatcatcactataacacgaaaatggtaatgacatcggaaattcaatttattcagttgctaagtttgcagcagggcttttgactgggactttcacgagcattcctgcaatgatagttaggattgtaacgaggaatgggaaaaatacccaaggaatgaaacttaatggattgatttgtaaggtactagcgatgaataccccagaaacactccatgggacaattgcgttgactgcggcccctgcgtcattgagaatccgagttaaatcaacccgttttaagcctaatttatcaaatgacgggagaaatgattgcccaggaagaataattgcgaggtagtgttccccaacaaggaggttaaccccaatacaggtaagagctgtggagaatgctaatcgaccaggcgtctttacaatcccagttaagtgattaatgatggcgctaataatattgaacttgatcaataagccacctaaagcaagggcaaagataattagggctagagaagtaagcatactagagataccgcctttagaaagcaatgtatcgattgttttatcaccggtatgggaaacgtaaccagtcatgatggtattagtaatcgtagtgaggctggttttaggtgcatgaatccagccaagtacgaccgcaaagagtgagccaaggccaagggaaggaatagcaggaacttggaaaatggctaatacgattaggagcagaactgggagaagagcccatccggagatccagaacccattttgtagcccggccatcatttggtgaacggcacctaagctaacatttttggagtttaaccctaagaaggtgtaaagaataagacagattgcccaggcaggaatatcggtggtgagtaaggatttaatatgcttgtagatactaatttcaccaacactggcggcaaggttggtggttcctgaaagcggggaaatatttgaaccacaaaaggcgcctgaaacaattacccccgcagttaaaccggggttgattttaagggttgcaccaatgccaataaaggcgatccccattgttgatacagttgtaaatgagcttccgcaagcgactccaacaagggtacaaacaataaaaactgttgggaggaagaactttacagaaatgatttcaaacccaaagtacataattgttggaatagttcccgagaaaatccaggtagcaattaagacaccgatagaaagaaagataatgagggggtcaacaccggctcgcaaaccatgacgcattccattcattatggtatcccatttaaatccacgaattcgtccgtaaacggcgagcaaaacaagggaaataaataatggggcttgcggttcttggtgcttaaaaataatagggtagcctaagatgcataaaataacgccaagaataagtaaactttcactaaaaccaatcactggctcaggactattttttgatttgttaataattttcattgtgtaattctccttgttttttaataaaaaataccaactagatcagcggcatttgcttaatctagttggtattacggtagtataaaaaatcgcggaaaactacacgcccttactagattaatgtacctagcaaaggactcattacaacaacaaccctgcttaggtacgaacaccgctgtccgtacctaaatgagtacagacaattatgcacggtaagcatagttgttataatacttggttgaagttaatgagtgttgaatcatgttagtcgttcctttcaagttaagttgtaattattaaaacattctaatctaaatttgtcaaattttaattttaaaattcaccagaaatatccttatcagaaaatgaatgaggatcaggaacaaaagaaatatcagtgtcaattattccaaatttttctcgcattacattttcgatgtgttctgataattggaaacttttgagaatcgtcattttagcgttaaccatcacggaagcatcaagcgtgaccacgtttccgttatagtgagcttttagttcgacaacttttacaacgtgcggaatattggtgattgtttgacggtattcctgttcagcgcggggatcaaagtagtcggttaagttaagactactttcaaagaaaatttttagtccagaatatagaataaagaaaccgacgacaatactggtagcaccatcaagccaacgaaggttaaagaggagggcaccaccaattgaaatcaaggttccaatacttgtgaaggcatcgctcagactatcttgggcagaagcaagcaacgcggcgttttttaacttaagtcctgtttggcgattcatataccaaacaactaacataataactgacgtgattccggctccaattaatgcgactggttgtggaaccacccgacttgcaggattgaggagacttttaatgccatcgatgataacgcttaaagcaatcgcaaccataacgaccgctgtgacaaggaaaaaattgtctcataacgccaacgaacaaattgtactcgttggtcagaccccatatgtgatatgtgcttgataatttccagaaggcagccgtgcgccaatgatatcatcatcatcgacatcctgggcgatgtgtaagcccatcatcagtaaaaaggtcgagataattcccgaaaggttgttgaaagcatcggcccgtaatgtctgcgatttacttatttcagccaaccagtactcaattattgaaataacaacataagcaaccaagttatagattaaatggtgttgggaagttcgaatctttgctagttcgtttgcttgcgttttttcccagttattcatttcttcggttgtatgtcttttaaatttagtcattaatttaagaacttccttgattaataaaatcagtttaattgtaacgcaaaaaataagggagcgagacagaaggcacttgtgacttcgtttttcgacgcgaagctagcctctgggagcccctgcaagcaacaataggcctccaacgttctttgacggacgttggaggcctattgttgtactgcgtagttgctttttatgaaagcaacttaacttatatcacagtcccaaaaataatgaaaataattgctaggcccggttattaattacgtgggcgcatgttgcaataatcagtcccataaaacttactacagcgatcatattactcataattgacatcatattgaacaactcctttacataattaaaatatttttacagcacaactaatgacagttgcctttttggaaaacaaattataatgattgttttcccctctccaccaagtattgtaacaggtcttagcagtagtgacgataataattagctaagcttttaatgagcttttttacgaaagaaaggagtgattataagcaaaatattataagtgactatcataggaattaataaattttaattattaagcaaaactaagctgattctttaaaaaataagttattcagctagtttgtttaattcttttaaggctaacgggaattttgtaaagccgtcactagtcaaaaagtgaccacctgtttctttaactatgagttttgctctaattttattggcgacttcaatgctattttgataaggaacgattgggtcgtctttagcggttataacggtagctttagcgagtttaggaaaaatttgctcataatgaggacgatctttcataaacccatctaattcgggataagctgataatcctttgtcaaatgctcccaccagtaaaagtcgagcatctttaacatgatgacgttcaatataacgaagtgccgtaatacaaccaagactatgagcgacgaggatgaggttgtcttggggattaatttggttgtcaaccgcttgatcccattcagcttgttggggattgaagggatttggtagccatatccgatcaagggcgattattggtttcgcttcttcttcgagccatgggaaccagtcgtcatcccgggtagaagtgccatgaattaagtatgcgttctccattattactactcctatttcataaagtgtttcaatactaccatgccgatgattaataataaaatggcaatcgaattagtaagaatttcataaggctgaccgtgggcggcaattagtccccgaattaaagccataattcctaagcttaatagaaaatcgactgcaatccggccatgatgttttagcgcggcaattatcattgtcataaatgaaaagaaaaggaaaaagacaataacgcgatccaaaatcttaaaaataacatgatccgtattcccatcttgcataaggggaatcagcgaaaaagtttctgtaaataaaataatagttaataagatccctaaaattgctagggcaccgattgtacatagacgcaaaatatggctaaaattagctgctaatttgtatatttttttcattctccgatactcctcaagaaaacgctttaactttaggatagcaatgatcaagaaatttagctaatatttaacaaaataattgttaaaaatatgcgatacttaaagatggataacaaaaggaggagtgagaaatgcgcaaaccctttattgctgctaattggaagatgcataagaatgtccaagaatcggttgaatttgtggatgcaattaaaggaaagctaccagatccgcaagaagttgaagtcggaattgcagcccaagcttttgcattacccagtatggttcaagccgctgatgattcaggattaaagataatcgcgcaaaacgcggcggctgaatattcgggagctttcactggtgaaattagcttacgaggtttagctgacgccggtgtttcatatgtaatgttaggacatattgaacggcgccatttattccacgaggataatgagttggttaatcggaaagtgttggcagcccttcaaatgggagttaccccgataatttgtacggatgaaacgatggtccagaaagaagttaatggtgaaattcactacgttttccagcaattgatgagcgtattgaggggcgtttctcttgatcaaattaaaaatgtagttgtttcctatgaaccaagttgggcagttggatatggtcagcatgctaatccagttcttgctgaagaaggatgccgtcaaattcggcgaacgattgctgataactacacttatgagattgctgataagatcaggattctttatgggggcagtgtcaatccagataatatcggaatgattatgaacaagccagatgtagatggggtattaatcggtcgggcaagtttagatgttgataattttttgcgaatggtcaattatttaaaaaatgatcaagaaaaataaaaaaagtatttctctttaccgtcattttgtgttatagttattaacagttgttatggcggtattggtgaagtttggttaacacaccggtttgtgggtccggcacgcgtgggttcgaatcccacataccgccctgacctagcgcgatggcaaaggatttttcccttgccatcgcgcttttttgtattctctgttttatgaattttaattgataacatccaagaaagtaacttaaaatagaaacagtataaggtggagaaagaaaaaaggggctttaattatgaaaaacgtacaaattggtggaacaaattgggaagtatcgaatgttgcattgggcattatgcggatggggacgttagcagtgaataaagcgattgatgccttagaagccgcccacgatgctggaataaactttattgattcagctgatatttatggcaacgacccacagttaggacgtggatcttcggaaatccattttggtgaagcattaaagaaaagcagtcttacccgtgatgacttttacattcaatcaaaaggaggcctttttgcgaacgcggatgataaaataacgcggtatgattcatcaaagaagcatttaatcgctgctgttgatgggattttgcaacggatggggattgattatcttgattcatttttgattcatcgtccagaccccttaatggagcccgcagaaatagcagaagcctttgaccaacttcaagcatctgggaaagtccgccattttggagtatcaaattttaatccgcaacaaatcgcgctccttcaagcggggacaaatcaacggcttttgattgaccaggtacaatttggcttaaagcatacggggatgattgattttggcctgcatacaaatatgactgatgatgctgcaatcaatcatgacgggggattattagaatatacgcgtcgtaaacagatgacgattcaaacatggtcgcctttccagtacggtacatttgcagggacgtttattaataatgatcaattccctgagttaaacgcaatgttagaaactcttgcgcaaaaatataaggtaagtaaaaatgcaattgctgttgcatggattttacgtcaccctgcgcatatgcaagtgttgcttggcactatgactccagctcatattattgatagtgctaaggggagcgatattacgttgacgaatcaagaatggtatgacctatatcttgcggccgggaatgatttgccataatgaaaaaagattatctccagttctatcagcatattacagctcctttttatcgacacccgtggacaattcctttattacgggcggttaataaatttgttgtgtggactatgtacgttgcttacatcgttatattagtgtgggtagggaaaaataatgtcttgaaagcaggaccctttctgctgattcccggtattggctttatcctgctttcttttattcgccaacgaattgacgcgccacgaccatacgaaaaatttccgattaaccccttaattcgacggcaaaaaactggtgattcattgcctagtcgtcatgttttttcggcgactgttattgcgatgtgtgggttaaggttaaatttgattttaggagtgattttactcgttttagctgttgtttctgctattacgagagtgattggcggagttcattttcctcgtgatgtggttatcgggtttatttgtggctttatttgtggttcgtttttatttcttgtctaaattttagaaaggtgtatttcatggacaattcagtgctgcaagacgcaattttgaatggacttattagtactcaatatcaaggtaatacgctgttaggtccgcaattattaaccaacaaccaatcatcgacaatttggcaaacgttacggcacgaattgctgtcatgtaaaaactttacgtggtcagtcgcctttattacgttagatatgttggttccatttaaggcagtgatggctgacttagcacagcagggggtacaagggacgatcattaccagtgattacttgaattttaatcaccccgcgatgtttgaagaattgcaaaagattcctaatttaacggttaggattgctgatcttaatggatttcatactaaggggtatttatttgatcatgggaaatatcagaccgtaattattgggagtgctaattttacacggtctgctttgttagttaataaggagtggaatttgaaattaagctcccgccaagaaggaagcctttttcaacaactaacggcggaattgaatgctgttaaacatgagagtaccgttctaacgtcagagtggattgcggagtatcgcaagaattggcaaccaccaaagactagggtgacgcaaccggaaaaattaaaaccaattgaacctaatcaaatgcaacaagccgctttaggacaattaagcactctgataaaaactggcgctaaaaaaggactggtcgtttcagcaacaggaactggaaaaacatatctgggagcgtttgctgtcaataaatatcagccgcgtcgtttcttatatgtcgttcatcgagaacaaattgccaaaaaatcgttagctagttttcgacgagttattggcggcaagaaaactgattacgggttattgacaggtaatcgccatgattggaatgctaaatatttatttgcaactgtccaaacactaagccaacaagcagtacttgataagctaaaagctaccgaatttgactacattttgatcgacgaggcccatcgtgcagcagcacctagttatcaacgaattttaaaccactttatgccgcaattttggttggggatgactgcaacccctgaacgaatggacaatcaagacgtctttaaactgtttgattatcatttggcctatgaaattcggctgaaagatgcattggctgctaaaatgttagcgccattccattacgtgggagttaccgattatgaagttgatggcgaagttattactgagacttctaagttaaaccaattgattgtttcgaaacgggttaattatgttcttaaccaattagactattatggatattgtggcgatcagcctcgtgggttagtattttgtagtcggcaggcagaggcaaaagaattggcagtccagtttaatgcggctaaccatcctgcgattgcattgacaaatcaaagtagtagtcaagagcgagcaaaggcagttgagcaattagaggcaggaaagattgagtatatcattaccgttgatctttttaatgaaggggtcgacatcccatcagtaaatcagattgtaatgatgcgtaatacccaatcaccaattgtgtttatccaacaactagggcgcggcttgcgtaaatatcctggtaaagattttgtgacagttattgattttattggaaattaccaacataattacatgattcctcttgcgcttaaccaggacaatagccgaagtaaggatcaagcgcggcgtgaagttaaggtgccaacgaattttgatgtttcaaccattaactttacgaaggttgccgaagaacaaattttagcctcccttgataaagttaaattggactcgatgcgtgaattgcggcaggcataccatgatttagctaaccaactagggagagcaccattgctgggtgacttttatcgttatggttctgttgatccccgagtatttgcgcaaaattcccaactcaaccattatggtgacttcttagaaaagatggggacagaacttaaattaactaagtatgagcgtcaagtactagcctttttaactaaagagttgcttaacggtaaacggccacatgaattgattctccttcaatgcttacttcgcggtacgtgttcaattgatgcttttaaagcagaattagagcagcaaaacattcgcgttacaccagctgttttacaatcagttgatgatattttaagcttgcaattctttaatgtaaaagctggtaaacagttaaaaaaggatcagtatggcggactgccgattattgatcatccagatttgttaacgtatcagttaaattcaaaaattcgagcaggactagaaagtgacaatgatttcaagtgcttgtttaccgatgtattaacaacgggtcttgaaatcgccaagcaatatgatctcaagcaagcatttaccctttatcagcaatatgaccgcaaagatgtttgtcgtttattaaattggcccctcgatgtaagtgcgccgttatatgggtatcgagtggcagaagatgtttgtccgattttcattacctaccataaggatgcggaagaaaaaaggaatgctatctataataatcaactacaagatggccgttcattgcgctggtacacacggacacctcgccatctttcatctgatgaggtccagcggttgcttgcaggagtaaaagagggtaagccgcaagtaaaattacacttgtttgtaaaacagagcgatgcagttggcaaagaattttattatttaggtcctgcttatgttcaaccggactccgtaagagaagaattagttgggccaaagaaaaaagcggcagtgggaatggatttagtcttagaacagccgttaaccccggcgatgatgaacctattagcaatataaacgtaaccatattgcttttgttttctactaaatcttctataattaaagacgaagaaagaagatgaatattatggcaaaaggaaaggtaaaaactagcgataagcgttcagttcgggatgttaaattagatgaattagctggcttattaaatgaatatgatgtcaacacgatgggggccctagtaaagtccttaaagaagagtcaaaagaagaataagcaaagcaagaaagatgaattacgcgataccattgaacggcaacaagaacatattgatgaacaaaaaggcacgattgatcaacttaacaatcacatttctaaactaattgatcgtcttgataataagctatagaaaaatgaggctgagaaaaaacttttgttttttcaacagcctcgttttttatacgaatattgttacgatatcgtggcactagcctcgagccttgtcgcggagattatttcccgcttccatttcttatcattcttttttatctactgattgtttaaataaatcattgaacgcttcgctgattgttgggtgggtatagatttggtcacgaagcatttgatagggaagttttgcccgcattgccagaacaatcatgttgataatttcttgtgcttcttggacataaagggtagccccaataattaagttcgtttgtggatcgactaataccttaagcagtccacgggtatccttcaatacttttgcttttggaattgcagcagcaggcatcttaaagagcaggtaatctttctcttgtttttgcgcctctctttctgttaagccgacttgtgcaagggaaggttcgataaagacgttagtaggaacaattaaacgatcactaattcggcgttccttattaccgaataattcatctttaatgatccggaagtcatcaagtgagatgtaagtaaattggggaccccctttaacatccccgattgcccacacattaggaacactagtgtggaggaggtcatcgacaacaatcgccccgtttttagcgaccttaatatctgtattttgcaaatcaagggccgctgttgcaggttttcggcctgttgccactaaaatcttatcagcaaaaatggttgtttcacgattatcagttctggcaaaagtaatcgcagcttgattatcttgttcgccaatcgctttaatatcaaccccaacttcaaagcgaaccccgttatccttaaagttttggattaccatttcagccacatcatcatcttcacgtggtagtaaagtctgatggtgatcaagaaccgtgacgtgtgaaccaaaggaagtgaacatatttgcgaattcaagaccaatataaccgccaccgataattacgagttcacgtggtaacttaggctgatccatcgcttgagtagaattcataagaaaacgactatcctttaatccaggaatgtcggggatggttgatgttgcaccagtattgatgaaaatacgttcgcccttgtaagaaagagtatgcccatctggcgtttgtacatcaattgtgtggttaccagtaaaatgagcggttccatctaagacagtgatattatcttcacttgctaacatttgataattcttttggcggagttgggatgtcatcacatttttcccatcgactgcgtcttcaaatgaggttccatgagcagcttcaataattagccgtttggagggaaggcaagcaatattaatgcaggttcccccgtacatttgcttcgatttttcaataacaagaacttgttctccgtgttgagcgagaaactttgcgagtgtttttccgcccttgccaaacccgataataatatttttgactgtttccattaaaaggcctccaaagttgaaattattttacatactttgaaattatactaagaataaacgctttgtcacttaaaacgcttaaatgagccaaatgtgcagtttgcgttttactgaacaaagtgttaggatgatatcgtaaatatattagtcccaactgcagtcagaacttgtatattaaagaaaaacgtattagataaatattgtacattattgatcataaagaatgtgctatcgaaataaaacgttttactgatttacaaaaagttttgattgaggagagattataatgaaagctgcacatttagtagaacaccccaaaaaagtaaatgaaaagaaaccagttattcaagagaccaagtttatcgacatcttaagcaaggttgcaacagttgtagctattttgatgtatgtatcttacatttcacagattaagaataatttggccggaaattacggtgctcctttacaaccattagtggcagcgcttaactgtacgttatggtgtatttatgcttacttcaagcagcaacgtgattggccagtcttctgggcaaatttccctggtattatctttggcttaatcacttttatcacatgtttacactaggaaaaataggattgcgagaaaacaaaattttctccagtcctattttttatatgctaactctcaactctatgatataattaatcgaacatatgtttaggaggagtagagatgccaaaagatgggatgtcggtagttcgctttagttcttttgcaccggtgacagagatgattttacagtcgttgccagccgagaaggacaaagaagaccagaaagcgccagccattaaaaactttgatcaattacgtcaacgattaaatagtcaagcgcgatttcttattttagaccttgagttttttcaggatcagcagaagcatcgaaatggcgttgctcagattgcggggaagatgtttgaaacacaaaacagctttaattactacctctatgcccagaatatgtctgctgagcgacaattggcctttttgcgacaatatgacctccgcctttcagaagtaaacggatatgaggttagacagacttttaaccggatttttcatttcattgcggtagagcggcctgactatattgtgagctgggataatggaactgactttgaatcattgaattatgaagcaaatcgattaaaaattaggaaagaggaccgtccctggcgcacgattcagtcgttagatctggaaaagctagtcgctaaagaagtatggaaaagtaaaagtgggatcagtttggaaaagatgtgtcgtttattgcatcttccccgggttaaatatcatcaagcccaaaatgatgtgatagcgattgaacaaatcttgaaattttatgctcgtgatttagaacgtgaattaaattgccgctgatcgttaccaaaatttaaaatttagttcatgatttatcccgattgactttttataattagtaacaattgaaagaaggtgaacgagataaatttcatttttcgactgcttaagcggatatttataataggacttttagtaggtggaggatggctttatttcaacgatgcacgggttcaagcaacggcgaaccaaactgcatggaacgttcgtgaccgtattgctaagttaattggcagggacgatacaaattcaaacgataattctaatctgcacttaaacgatgcaaataatggttcttccaaaaacgaacaaggaccaacgacagaacaacaaacaagtacacaaacttcaattccatctactgggcgatgggcgactaatcaagcaacagtctatgtaaatacaaataatgctcaacttgacgcagctactaataccgcaatccaaaactggaatcaaacgggggcatttacatttaaaccagtaaacaatcaaagtaaagctgatattgttgtaacgacgatgaaccgttctgattcaaatgctgctggattaacgaagacatcctctaattcattgacaagaagatttatgcatgcgacggtgtacttaaatacatattatttaactgatccaagttatggctatagtcaggaacgaattgttaatacagccgaacacgaactgggccacgcaattggactcgatcataccaatgctgtttcggtaatgcagcctgctggatcattctatacgatccaaccagatgatgtgcaagcagtccaaaaactatatgctaataataaataaaaatgggactgtgacataagttaagttattttcataaaaagcaaatacgcagtacaacaatggcctctaacgtccggcaaaaccgaacgttagaggcctattgttgcttgcgggggctcccagaggctagcttcgcgtcgaaaaacgaagtcacaagtgacttctgtctcgctcccattctatttagtctgtcattttccgtgcttttagtgcccataggatagagacagtatcaattacttcctgtaacatggcgccgaaaaaggccggaatgattccggtgctagcaacaagcattaggatggtacagattgcgattccgattaggaccgcctgttttgcaatccgcagagtttcctgagaaatgctaacggcttttgcgactcgcgaaaggtcatcttttaggataacaacggcagcggattcactagcagcagttgatccgtgagctcccatcgcaattccaacatcagctgtcacaagagaaggtgcgtcgtttacgccgtcaccaaccatgaaaacaggatgttcatttgttggaatagctttaagtgcattgattttatcttggggaagaaggtcggctttaacctgcgtgatccctacttgttgggcaactttatctgcaataacagcttggtctcccgttaacattaatagattggtaaccccaagcttttttaactggttcattgtttgctttgcttcaggacgaatatgatcggtaaaagtaattgcaccatagtattgcccatcgacgctcacatagatagccgttgatgctaacatctggttaagattttctggtgatacgaattttaattttcctactttaacttcccgtccatcaacagttgctaaaattcctttaccggttatttctgtaagttgatcgacaggtgataaggaaacattatacgcagtggcgtaagaaagcagtgagcgtgctaggatatgtgatgattgttgttcagcgcttacggcgtaatggaggagctgagttgagtcaatttttcctgtcggcaagattttatcaacagtcaattgaccacttgtaatagttcctgttttatcaaatgcaccagttttagcaaccgctagtttttccagtacgctccctgtcttgaccacaattccgtttcgtgaagcccgactcattccagaaaccattgccactggagctgcgagaattaacggacatggtgaagcaacaacgagaacctccgcaaatcgttcgggacggccagaaagcacccatgcgagtgaagagataataatggcaataatcgtaaatggaacagcatatcggtcggctaatcgaacaaagtgggcaggggtggattcagcctccttaaccaatttaacgagttgctgatattgactatctttggctagcttggtgacctgtaaagtgatggcattatcaccattaacagatccagacatcacttcatcaccggttgttttggaaactggccgtgattcaccagttaatgaagactcatcaaataaaccttcgccgattttaatgattccatcgactggtactaattctccaggcttaacgataagctggtcaccaactttgacatcgttaactgggatgtcgctggttttgccattggtgattaaatgcgccgtttgtggtgagttattaagtaatgcttttaattcggtgcttgcttttttggcagcataatcttctaaggcatctcctccggttaacattacaagaataaccatcgctgcccagtattcgctaacagctagcgttgcgacgacagccataatggcaagcagatcaacgccatatttaccactacggatagtttttatcatgccaataaacattgaaaaagcaacaattgcgccgacgacagtaactagaatttgagcaaaaagttgtaaatgaaatccaaattggagcacgactgcgattgctgcaattactaggataatgattaatttttgtttattagatagttttttcataatacccccgcttagtcctcatactttctacaatttaattataggatttttatgcaatgatataataaaaaattagaaatattaaggaaactggtgaaaaagaatgcaaaatggacaatcttatcaacgtatttttgtagtgataattgattcattagggattggagcaacggctgatgccaatcattttgagagtttaggggctgacacgctaggacaccttggggaacattttcgcgtacggctacaactaccgacttttcagaaaatgggtcttggcaacttgcacccgattatggggatgccttcgcttgaaaatcttcacgctgtttatggtcaaatgagttcaatttcaacgggtctgagtgatcgggagagccagtgggagatgatgggcttggcaacgaccgctgaacctgacgtttttattgatggtgtgccgttggaaatagcgattaattttgcgcgaaaagcaaagcgccctcttttaagcaattccttaatgaatatccgtactgcgttgaaagattatggccttgaacaattgacaacaggtggtctgctagtagcgacggctagttcttcgagtgtttggttaattgcgcatgaacagactatttcagttggcgaattaaaagaagattgtcagattttgcgaaaaatgttggataattccccatatactatcgaaaatgtgaatggtcttctttttagcgggaaccaggcggctaatttttatccccaagaactttataaatttcctttagctccagcaagtccaacggttattgattgtctcttggaagagggttatgctgtgaagttaatcgggaaaagtacccagttctttggtttggaccataatgaaataaccgggaataatcaagagagctttgttcagttgaaagaactgatcgagaaaaagtttacgggtgtttgtatagcagaagtgggggagatagagcaatttggtaaagcgcgtaatcctgaaggctttggaacggaattgatgcgaattgaccacgaacttacaaaaattatcgataaactacaagatgatgatttactgattgtgacagggaactttgggaatgaccctacttatcctggcgaaaaacatactcgtgaatatgtgccgttacttgtaacatcaccacagataaaaccaaatatttcgctcggtggcagaagttttagcgatattggggcaacaattcttgataattatgatttaggagataagttgccagttggtaatagttttttaagagaattattttctgcatattgataaaagaggatggaaaaattctgattttccgtcctcttttattgtgactatattaacgatgaaatttatagtaaatagcaattcccataatcaaaagaaggacaagggcagcaagacgcgggtttgttttaaataactcgtgcattgcatgaatttgtccaataccaaggggaagagtaaacatagaaaagacaccctttcaaaatttacttaagagcttagtagttttttataaggaattctttcatatctgttggttgatgtccagtgatatgcgcaaagtcgtcagtaacttggtccatcaagcccattgcagctgcttggtacatagaagcgagttcgtttccgtcaccctcagcagcgtaaatttcagcaaatctttttacggtaacggggtcataaccaatttcttcacccgtaacattagtcataatataactaagttctgacattgtataatttttgctcatggtaaggagataattttgtcccttgtctcgcaagtatggcttgactgctacattggcgatggcttcagcactatcttggcgggaaataaaactcattgcctggtcaccaaccgggtaaatgatgttgtggcgttcaattaattctggaaggtaagggactagtgggtctgcatacaatgaattcttaacaacagcgtatttaaggccggaactggcaagccgtgctggtaagtatgcatagtaaccagccatttggaaaggattgttatattgatctgcaataaaactaacatcgactaaattatgaacgtcagccttaaatattgcggttaatgaattctcaaattcgtcaattcgatccttaactaagtaggtgatgcttggaatgtagataacaacatcgattccgctaaaggctgccgtcatcttagcaacgtcatgatagtcaattgcggcaatttcatatccggcatctttaaattgagaaactttggcgggattgtgaacaccgacgcggatgttatctggggatgtaagtttgcttaattgcttaacaacgtgttgaccaaggtgcccggttgcaccagtaaccatatacttcattattagttccctctttcttttttggcatcttttattgcttgcttaacgcgaatagtgtcgatgacatcttgtaaactggtttttgcaagtttggctttcgcggctgtttctgcttgttggtaaaagccatcaagcgtctcttggatattcccgccaacgatgcattggggatttgttcgttcatcaattgtaaatagatgagcatccccttcgatcgcaagaaaaatatcatagagtgagatattttcgggtgattttgcaagggctggatcagctgcaccatggacggtattgattaagccagctttattgagcgcgctcatcaaacgtcggacgacaactggcgaagtttcaatgctgctagcgatattattacttgttaatggaatagttccttgataaatattaatgaaagcaagaatatgaatgctatcactaaaacgggttgaaatttttatattatcattcctttaattatgattgtaatttatggagttacatgatgtcaaggggttgaatttatcattgccttgacaatttttttcttagatatagtattagtttattgattgaaacttttttagttacaagttaggagaaaataaatgagatttaagaaaatcgttgctctttcattattaagcattgctgggttgctagcaggaactattacgccggcagtagcaagtgctgccagcaataaaccaattattgtgggttcaaaaaatgtttcagaaagtaagactgtcagtgaaatttacgcgcttgcacttgaacatgagggttataaggttactcggaaacccaatatttcaaataatgtgatttttagtgcaacacaaaaaggcgaagttgatgtttatcctgattatacgggaacaattgtagaggcgtaccttaaaaagaaggggaccggcaagagtgctagtcaaatggctaaattagcacacgatggtattcaaaaagacggtttgacgacatttaaatacgccccgggtgataatcgccaaggtgttgcaatgccaactaaggacgcaaagaagtaccacattaccaatttaagtgaactgcaaaagaatgcaaagaagattaactttgcttcacagggtgagttcgaaaaacgtgctgatgcccttccggaaatgaataaggtttatggtaaatttgattttaagtcaattaaggattatgacgtaaatttactctacaagattatggaacaagggaaagcacaagcagctccggtttcaacaactgatggtcaattagcaactggcaagtttactttactaaaggataataagaatatttggccaccatataatttagtgccagtagtaaataaaaaagctgctaaaagtcatccaaaaatggagcaagccttaaataaagttgatgcgaagttaacaactaagcaattaacagatctaaacaaaaaagttaatgtcgacgggcaaaattataagactgttgctaaaaattggtataatcaaaatatgaaataagtgccaaaggggcagatagctagtttttttattgctagatatttgctccttcgttataggtaatagatggggagtggtagcttgctagagcaaataattcagtattttcaaacaaatagcggccaatattggcaatatgttggtcagcatataattctgactgttgtaacgctcgtgatttcaatgatcattgcattgccattaggatatattggttcgcgaataaaaccagttgctcaattttgtgtgatgtttgcgcaattgttgcgaattattcctagtttggcattgctgtttttattaattccatttattggaacgggggttgtccctgcattaattgctttaattgttttagcgcttccgccgttgctaatcaatacaattcttggttttaatgaagtgagtccactatataaggaagttgggatagccctagggatggatcagcgtcagttgcgccggcaaatagaaattcccctggcgttgccctatattttaaacggaataaaactagcattggttgaaatcattgctagtgcaaccttagctacttatattggtgctggtggattgggaaccctaatatttaccggcttaggcttatacgatatgagttatgtagtgattggcgcagtaagcgttgctattttatccttgctggcaatgattagctttgattttttaattagaaaggtacaaaagcatgacagaaccaattattcaatttaagcatgttgagaagcgttttaacgatcaaacagtgattcctgatctcaatttcacagtcaacaagggtgaatttataacaattcttggttcatctggctcagggaaaactactaccttgaaaatgatcaacgggctgataacgccaagcgctggtgaaatattaattgatggacaaaaacttcgagaccttgatctggtaaaattgcgtcggcacatgggatatgttgtccaacagatcggattattccctcatatgacgattggacaaaatattgcagttgtgcccaaaatgctgcattgggataagaaagagattaataatcgtgttaaagaattactaagtcttgttcaactaaatcccgctgaatatatgaatcgctatcctcaacaattatctgggggccaacaacaacgcgtaggagtggcaagagctttagcgactaatccaccgtatgtattatttgatgaaccttttggcgcgctggatgccttaacaagaatggaattgcaacgagaagtgaaaaagattcatgaatcattggcagaaaagacttttatgtttgtaacccatgatattaacgaagccttatttttaggccagcgagtgatgatcatgcatgaaggacgcatcgttcaatttgctacgccagaagaaattgttcgccatccagcaacggaatttgttgagcagcttttaggaacgattcgccaaaatcaagatttgtggaggcaacaatatgagtgagtattggaatgagaattggccgataatgcttgatgatgtccagcaacatgcaacgatggttctttcttcattagcaattgccttagtgattgcagttgtaataatcttattattcttacggcgtgaaaagtggcttaatagtttgatctatttcttttcactcttatattcaattccaagttttgcattttttgccttactcttgccgatttctggattaggaatgaagactgcaattattgttttaacgatctactctgaatatgttttattacgttcctttattacgggaatccgtggcgttgatccacaattaatcgaagttggtgtggggatggggatgacatctcgacaggtttttcgccaaattcaattgccacaagcattaccggcaatttttagtggaatccaagtggccctagcttcgacaatggcaatggcaactattgcggcaacgattaatgccggtggactggggcaattattgtttgaaggactgcagggccaacaggtagtgccgattttgtggggaacagttttaacaatggctttgacattaatttgcgcaggaattgttcaattgatttcgtggatgttgttgcatcggtggaaaggagtattaaataactgagcaggaaattagtagtattcactgagaattcgtataatcaaaataggtaacgaaaacgaggaggatgctgaatggataaaaatgaattaaagaaattaacgccaatgcaatatgctgtgactcaaatgggagttacggaaaagccatatagtggtaaatatgatcgatttgatgaaccgggtatttatgttgacgttgttagtggggaaccattattctcatcattagataaatacgatgcaggatgtggttggccggcatttactaaaccaattaagaagcgtgtccttaccgaaaaacgtgatcaatcatttgggatggaacgaaccgaggtaagaagtaaggaagctgattcacatctagggcatgtctttactgatggtccaactgatcgcggaggattgcgctattgcatcaattcagccgctttgcagtttattccggttgataaattgcaagaaaaaggctatggagaatatttaagtttgtttgataaatagctaaaaatcgagaatgggagaaaattttgttttttcccattctcgattttgattttaaattatttatttttcttctaacattgcgtcataaagtgagggacgaccacctaataagcgattaacgtaataggcgactaaagtaattaaagtcattggtaaaatttgttcaactgaacccaccatttcagttactaataaaattgctgtaaatggtaatccttctgccccgccaaaatatgcagccattgaaattataatgacgttgacataacaactagctgggattattcccatatggataagaatggttccagtcaatgcgccaacaacggttcctaaaacgaataatggcatgaaaataccacctggaactgtagcaccatacgcaatcattgtgccaccaaaacgaaggataaaataaactaataaaattgcgaccattgcttgccaattcgttgaaagtgacatattagtgacatatttaataaaatcgtgactaccaccaagaatataagggttccataatccaacaggaataactaataatagtggaataatgctatgaaattctttggggataaatgtgattttgctgtaccaccaggtgaggttgagggcagcaaattgaaaacagtatgctaagaaaccaatagcaacccccgcgatgattaaccatggataagatgcaacaggcaatttggttgtgattggaatatataagcagggcttaatgccaaaaaacaaaaaagtaataaatgcagaaacaatggaagaagttaaagcgggaatccaaattcgggaattgaaattatgcgtcatttcttctagtaaaaacattgttcctgctaaaggagcgctgaaagcagcagataacccggccgcaacgccacattccattaataaatatttatctttatctgtgaggtgaaaaaatttttcgttaaagcaagctccaatacaagcaccaatttggatacttggtccttcacgtcctaagaaaagtccaggacagatagtgagcaaactagcgacaaactttcgccataatacaggccaccaatggatccggtgtcttcctagcaaaacagcttttaattgtgtaaccccggaacgaacaacgtcctcttcatagggctttacaatttttccaattaaccatgcaacgataaatgtacctaatacataaggaatcaaaactaagggatgttttcccataaaaggatagataatagtaagtaaagtcagcgtatgatcgataatccagcgaaagactccgattacaagaccagttactatcccaatagcaatactaacgccaaggtaacgcgaaacaatggaggtgaatggttttcctaaaatgtcccgtgcccgtttgtgatataaggtattttcatttttcacaaatactgcctccaatacggtgttttccctatattagcataaaaagagagtgaacaataacagtctgcgagagataagtattgttcactcttattttctatgagctttttaataaaatctatgttggtgtttaccacccacaaataaacttataattgaagctaataaaattgcggaaaaacttacaacagcgattacgttactcaataatgacatcatggtaaacaccctttcttaataaaattgacatcgctttcatcgactacattttaacattagttggctataattgattaaaaagcatctcttattttactaatttagggtattcatttaaacatcttgcttattctttgaagaaatcacgaataatttgcttataagctttaattgtagcgacgtaactggaaatagttgtatattcatcattttgatgagccgcattccaatcatcacaacctaaaattacaaccggaagatctggccgatttaatgtaaatacactcgcatctgttgcaccattgataatatcgagtttgatatcatttggataattgcgctgagcagcattgagggcgatttggacaaaatcattattaggttctgttgcaatgggatagaaatcttgaataatttttagttctaattggaagggagttgtgtgattaatgtattcaagcgcatcgtttaatcgatctgcaactttaatattattaaatgctgccgtgggacgaatgttgccatgtaaactagcgctgtcggggatggtattaacttgtgacccgccatcaataactgtaatactatgctgcactttaccgagatactgatcatccttgctattatcaaaaaggtgtttttcttcttcgataaactttagcaacccttcaattgcattaataccgttttgcggatgtgaactatgacaagactttccatagctagtaacacgatagttcatacttcctgagtgagcaaaaataacgtttccgccagttggttcaccgactactaatgcatcaagatcatcggcaactccttgtttttgtaatcgataggcaccaggagtaccaagttcttctccggcggtagcaataaatctaaccgttcctgatggcagttgaccagcttcttttaattcgattaagacgatggcttgagcagccagaccgcttttcatgtcagcggctccccgaccgaaaacataatcaccgttaatttcaccgccaaagggatcatgttgccagcgatctggattaggtactgccacagtgtcttggtgcccagtaagtccaagaatttttttgctttcaccagttccgatttccgcgatcaaatttgcacggcggtcaccaaattcatcaacttttgaatcaattccgtgacttgataaaagtttttgtaagtagtgggctacttcaacttcatttccattgacagaatggatttttattaaatcttgcagtactttgactttttcactgacttccataataatccctcctatatgttaacggtcttggtggttaagcttcttggctaaaatatcgccaactacttgaatgattaaaacaaataaaagaacaagaatcgtggcgacaagggttacgtcgttgttaaagcggtcgtaaccgtatgaaatagcagtattacctaaaccaccagcaccaattgcaccagccattgcagtaaggctaactaaactaattaatgtaacggtggagacacggacaagttcagaacgagcttcgcggaggtaaacgtcaataatgatatcccagttagtagccccaatagcttgggcagcttcaattttaccgtgatcaacactttcaagcgcaacttgaacttgacgagcatagaaagcaaatacacctaatgaaagtggcactaatgcggcggttgttccaatctgtgttccaacaatcaattgggtgaagggggcaatgaaggccaacaaaatgataaatggaattgcccggaaaacagatacgactttatcaacgatactaaaaacaattcgattttctaaaattccaccgggctcagtaaccacaagcgcaactccgaagattaatcctaaaattccgccgaagatagcaggccagaaagtcatgtagatagtttgcacgattgaagtgccccaaccgttgtcaccaccccaaccaagttgaattacatttggtataagattattcattccaaatcctccgatcatcaatctttgtgacagtaacatcgttttcttttaagaagtcaatagcttgttgacgcttatcagcatcgcccttgataaccacaaacagggtaccgactggtgaaccggccaagacttcaatgtttccataaagcatacttgcttcaacttgcagcttcttatataactcgataatgattgatttagtcacgttatttgcatcgtagaccaattgcagcaattcttcatcatcgtcaaggtggcccaggtcaaatgctttaagggtatcgattgcggctaaggaacctcccacaaattgacgggttaagtcctgttgtggttggaggaacaccttctgcaaggtgccgcgctcaatgatttgtccatattccatgacagcaatcttattagctactcgtttaacagcgtccatttcatgagtaatgaggacaatcgttaaatctaatttttcgttgagccgtttaagaaggtccaaaatctgattagtgttttggggatcaagagccgaagtagcctcatcagaaattaggatttcaggatcattagctaatgcccgggcaatggaaacccgttgttgttcaccaccagataattgaacagggtagaattcagccttatcctttaagccaactaagtctaaaagttcaagtgccttcttctcttttgcgtcatcatccatgtcagtatgtttaagagcgaaaaggacattttcaattactgaagtttcatttaataaattgaagtgttgaaaaatcatgccaatttttcggcgcttttcttgtaactctttattactaatttgctgttgatggtctttgaaaaaaacagtgccattaactgttactgatcccgcagtaggaagttgtaggaggttgatggttcgaactaatgttgatttaccagctccagaataaccaacaatcccataaatatcgcctttttctacttttaaggtaacatccttaacggcatgaacaacctgttttcgttgcttaaaagttacgctaatgttgtctaagtcaatgatcgggttcgccatattaatcctcctttatttattgaagttgaggtcccaagcaggaatttctgctgttccgtatagtttcttaatttctcgttttgttttttcagtttggtaagcacgtacaacatctttgtaaatcttgttgttcttttcactgcctttaacagcaataatgttgacccattgctttgaatccctgttaactggttcaacgaaaatagcactcttataattaagaccagcagcttgcgcatagttagtgttaactactgaggcatcaacgttatctaacgaccgggctgtttgatcagcggctaattctttaatcttaagatcgcgtggattcttggaaattgaacttacagttgcaagctttgtgcccttcttgaggtcaatcaaaccagcattctttaatgcgaataatgcccgtgattcgtttgaagcatcatttggcactgcgatcgttccaccattaggaatttcctttacactcttgtattgcttggagtataaccggattggagtgataaatgtatcacctaaagaaacaagatcagttttatgggctttattccaagtttgtaagaataacttgtgttggaaggcgtttaagtcaacatcgccattttccaaagccttgtttggttggttgtaatcagtgaatcgtttgaattttaaagtaacgttgtacttatctttagcggttttgcttactgaattccaaatttcatcgtcttgttttgaaccagccataatcccgacagtaacagtccgttttgcttgttgttgcggacggataaaactaaagtatccggcaataacaacgataagtgcaactactgaccaaataatgatgtttcttcttttctttctcttcatagtaaaaactccctttcaatcaattaaatattttcgttggttaattgaagcgttagattgctagtaaataaaaaagcactcgtccctttattcaaaggacgagtgctcgcgttaccacctttatttgctgaatcttcacagacccagcctcagtaggttactctaataaaataattagaattacctagcactaataacgtgtgctaacccgttatcgactaacaatcatcgataccattccaagcccatcttcagtagttacgcttgcttctttacaccacccagaagctctcttgtaagcctcgctacttactctgcttttcgatatgttttaacgttcaattaattattatgtgttccattataatgattctctaatttttgtcaacgcattttttaatttaaattttgttttatttgggtcatcaatcgttttttattttgcctatctatagtaattaaaaaacaattatgttaagattaaaaaatgattaaaaagaaattggaaggggtcttagtaatgacacgaaaagttggagttatcggaatgggtaatgtggggtcaacagttgcccactatattgtggcaatgggttttgcagatgacctagttctgatcgacaaaaacgaagcaaaggttaaggcagatgcacttgattttgaagatgcgatggctaatctgcctttccataccaatattactgttagtgattacagtgcattgaaggatgcggatgtaattgtatccgcgttgggaaatatcaaacttcaagataatcctaatgctgatcgttttgcggaacttccatttacccgccgagcagtaaaagaggttgcacaaaagattaaggaaagtggctttaacggtaagattgtggctattactaacccggttgatgttattacctcgctctaccaaaaaataactggtcttccgaagaaccatgtattaggaacagggaccctgcttgactctgcacgaatgaagcgggcagtggctgaacggcttaacttagatccgcgttctgtagatggttataatcttggcgagcatggtaattcacaatttacagcatggtccactgttcgcgttcttggccgtccattaactgaattagcggataagcgtggattagacttagaagagcttgataaggaagctaagatgggtggctggactgtctttcaagggaaaaagtatactaattatggggttgcaacggcagctgttaagcttgtcaatgcaattttatccgattcattgactgaattaccggtatcaaatttccgtgaagaatatggagtttacttgtcttacccagcggttgttggtcgtgatggagttgtagagcaagcccaacttgacttgacagaagaagaactgcaaaagctgcaaacatcagccgatttcattaaggaaaagtatcaagaaagtttgcaagcaaaagattaaggaaaacttaaataaagaaaatagcctagcataaaaaaattatgcatggtagagttgcttctatacttaacaaataaaagtggcgtcatcagataaatttggtggcaccacttttattctgtaaaaatatagaaaggaaatatatcatgacaaaagaagtaaagcgtataatctttgtagttcttttttgtgagtttttgatttgtctcggaatgagtcttatcttcccagttgaaccgttcattaaaaatgaataccactttactgcctttgacatgggagtgatgtcttccctatttgcgtttgtgcaatttattgcttcacccattgttggtcggatttcagacaaggttggacgaaaaccaatgttagtatggggattgctgatatttgcgattgctgaatttgtttttgccttagcacagcatttatggttatttgacttatcgcgggcagtagatggattatcagcagctatgtttgtaccaacatcaatggcattagcggcagacattactagtgaaaaagaccgcgccaaagttattgggtggttatcagcagcttttagtgggggattaattttaggaccaggtcttggtggaatgttagcgcatgtaaattataaattcccattttgggttgctggtattctgggattgattagtacggttgttgcctggcgctttttacctcatgatgaggatgaactatttaagagtgaaactaaaaatccggaaaatgaattattgactggtggttggagtcagttgaaacaaattatgaccccaatactaatcacgctctttggaatgatctttgtagcttcatttggattagctggctttgaaagtatctatagtttatatgtcaatgaagttcataattttgacttaaacgcaattgcgcttgttttaactctcaacgggattatttcgcttattctgcaagtctttttctttgatcggctagttcgttggctgggagaagttcgactaatgcgatacagttttttccttagtttagttggaacgatcatggtgatttatgatcacaatcattggcatatcattattgcaaccttgtttgtttttgaagcgttcgatctgttgcgcccaacaattactacattattaactaagatgagcaagacaaaccaaggattattgaacggggtaaatatgtcattgacaagtgtggggaatattattggaccgcttattagtggctatttattagatgttaattatcaatatccatattggttcgtatcgatattcctaattatttcctgggtaataacgcttattttaggacgggaaagaaaagcagctgctaacgattaaatatttaactttattaagaaaatagcgaggaattaggaaaaataaaatttttctaatttctcgctattgttgtatttatgcttaattttgttgtgcctgttgcaatgcatccttggttgcttctttaatcgcacgacttgttgcactggccccagtaatgccatccacgtctgcactattagccgcaataattttaccgggaagttcatctaaagcccattgacccatttcagattcatgatgtttgattacttgtaaatcttgaatcttatcatcttggtaggttaataagacttctgattcaccgccataagcactaaagccacttccaatatattgatttctgtctatttctctcattttattattatccataatcttctaagttaaatcacattattttggcctgttacgcagagtgataacagtggacaagtttgacatttaggatttcttgccgtgcagacatatctaccccaaaaaatcatactatgatgagcatctaaccagtgttcaggaggtatagttttcattaacttcttttcaattgcaagaacggatgctttgggttcaaccattctaaggcggcgggcaacacgactaacgtgggtatcaactgggaaagctggaatgttaaagcattctgcaaggacaacatcagcaactttcctcccgactccagataaggttattagctctttgagggtgtggggaacctcaccgttaaagtcagtaacaatttgttgagaagttttgactaagaacttagctttatttcgataaagccctaatcttttgatataaggctcaacttctgcgggttcaacccctgctaaatctgctggcaacggaaaacgagcgaatagtgctggcgttacttcattgacagattgatctgttgactgtgcactcaagattgtagccaaaagaaagtggtagtttgtgtcagcaatcaaagttgttcctgcttcgggaaatgtttgccgcatgaccttgattgagtaacgaatttcgtctggtgataacatataaaatcactcttttcgaatatgattataactattttaacccgaatgattaaaatagcgaagggtaataacctcattttatactcattaaattattatttataaaattgggggttagcaatatgacatcaatttatgttaaggaaaaaatgtttaatatggatgcaaatgtagaaatctctttctttaattaatttaaataaacgattgaccagagaagagcaccttggtaaaatgtattaaagattttcttataattctaatcaaattttaatcatttagaaaaggaggatgattatgagtttttggaaaacaattacacgtaaagaagacccgcgtgtttatgataataaagacggtcatttagttcgatctttgaaggtgcgggactttttagctttaggtgttggaacgattgtgtccacttccattttcactcttcctggtgaagtggccgcaatgcatactggaccttcagtagttatctcttttttaattgctgcgatcgtggccgggctagttgccttcgcctatgcagaaatggctgctgcaatgccgtttgctggttcagcctattcatggattaacgtcgtgtttggagaattttttggttgggtcgctggttgggcactattagctgaatactttattgctttggcctttgttgggtctggtctctctgctaacttccgggcattatttgttccgcttggctggaagctgcctgcttcattatcaaatgcttttggtacagaaggcggagttgttgatattgtttcagttgttgtaattattttagtagccctcttaatttcacgcggggtatcacaagctgctcgtgttgaaaatcttcttgttattcttaaagtttttgcaattttactttttattgttgttggtttaaccgctataaaagcaagcaattttatgccatttattccacaataccatgaaacagctaatggtgcatttggtggttggcagggtatatatgccggggtatcgatgattttcctttcctatatcggatttgactcaattgctgctaattcagcggaagcaatcaatccacaaaaaacgatgccacgtggaatccttggttccttagtaatcgcagttgttctttttatagcagttagtcttgtattgattggggtattaccatatcaacaatacgctaatagtgctgaaccagttgggcttgcattacgtgcagctcatcatagtggtgtagcaactgttgttcaaacaattgctgttctaggaatgtttaccgccttgattgggatgagcatggctggttcgcggttgatttactcatttggtcgtgatggaatgttgccaaaatggcttgggaaacttgatgaacataatcgaccaaaccgtgcactttggacacttacaattggtgctgttttgatcggtgccttcttcccattcgcctttctttcccaattgatctcagccggtacattgattgcctttatgtttgtttcacttggtgtttatgcattacgtcgtcgtgaaggaaaagatattcccaatccttcatttaagatgccattctatccagtattaccagctctaggttttcttgcttcattacttgtgtttatgggattagattaccaagcaaaactttacgctggtatctggtttatctttggcttaattatttactttgcttatggaatacgccactcgtcaatggcaaagaaagaagatggacaaaatgttaaaaacgaaactgaagcagaagaaaacgaatagagatgttttattagaagaaaaaaatgcatttgcgagtgctgcccggattaagtactacgatattgtattagatcatggacggggggcaatggttactgatatagaaggaaatgattatatcgatttgcttgccagtgctagttcgactaatactggccatgcgcatccgcgagtagtgcaagctattcaagaacaagcagctaaaatgattcagtatactccagcgtactttgctaattcacaagcagcgcggttagcacctcgattagcagaattagcgccgataagtgggccagttgaaatggtatggggtaattctggttcggatgctaatgacgcaattattaaatttgcgcgagcatatactggacgccaatatattatttcctttacgggggcctatcatggttcaacttacggttcaatgagcttgtcaggtgtttcattaaacatgacaagaaaaatgggtccaatgctaccaggcgtagtaaaggtaccattccctagtccatgggaacgattaactaatgaaagtgacgaagcgtttgttgagcggatgttccatcaatttatgctgccttttgaaacttatttaccagtggatgaagtagctgcaattcttattgaaccaattcagggtgatgggggaattgtaaaaactccgcctgcttatatgcaaaaggtatatgagtttgctaaagctaatggaattctctttgctgttgatgaagttaatcaggggatgggacggactggtaaatggtggtcgatccagcattttgggattgagccagatttaatgtctgttggtaagtcgttagcttcgggaatgccacttagtgcaatgattggtcgtaaggagattctggaatcattaggggcgccagccaatgtttacactacagctggtaacccggttacgactgcagcagcgaatgcgaccttagatgttattcaaaatgagcatcttttagagcgttcacaacgccttggcaaaaaagcagctgaattctttaagcttgaacagcaaaaatatccttttgtgggtgacgttcgaatgtatggactggatggtggtattgatatcattgatccagttacgggaaaaggtgatacagaagcaacaaccaagctaatgtaccgcatctttgaactaggagcaattatcattagtttgcgggggagtattcttcgtttccaaccaccattagttattacagaaaaagaattagatcaagcttttgcgatgattgatcaagcattcgcggaattagccgctggtaaattagctgctcccgcaaatgcagaagagttaggttggtaactcttgcaatttaagaccatcttcgggtatactttaagcgccatcttagctcagctaggtagagcacatccatggtaaggatgaggtcggcggttcgaacccgctagatggcttaaaatgaactaagaaaagagatttagaaaaacaaatcgtttttctaaatctcttttcttctttataagaatatggccttgctagtaatataattaggattgaaattacagctatgttaaaatcaaaattatgtagcattagcttaattgataaattggaggaaaagaaatggaatttattgcagtgttggcggggttattgcttgcaacccagatcgtagcacacttatgtcgtcgtgttgagattccagaagtgattggacaaatcctggttggaatcattgcaggacccgctgttctagattgggttcatttaaattcaatgatgaatgaatttcaggaaattggggttattatcttgatgttcatcgcaggattggaaagcgacctatccttgctaagaaaatacttgaagcccgctgttgttgtggcgcttttgggggtaattgttcccattgtaattatgggaccggtaagttatatgtttggctttactaagcttgaatcactatttatcggggttatttttgcgacaacatctgttagtatttcagttgcagttttacgtgaatttaatcgcctagatagccgagagggggcaacagtgcttggagcagcggttgccgatgatattattggtgttatcttattaagtgtgatgattagtgtaatcaatggaagcagcaatagtggtcacggcaatggtcagcctttaggaattgtcctcttgatgcagttagtattctttggtggaacttacctattgattcgttggttagcaccttacctaattcatatgagtgatcgcctattaacagttgcttcaacgtcggtaatggcgatgattatctgtttaggcatggctgcaattgctgattatgttggtttaagtggggctgttggctccttcttcgctggaattgctgtggctaacaccaagcataaagaagttgttgaccggagttttattccaattgggtatgcaatgtttattccgctattctttgtcagtgtagggttgaacatgcgctttgataatattggtgaatcgtttgtctttgttattgtaatgacaatccttgcatgcttaacaaaactgcttggatgtggagcgggtgctaagctatctggctttagtatgccaagttcttatgttgtcggtagtgggatggttgcccgtggtgaaatgggattgattacagcccagattggttatgaagcacatcttctttcgccaatgtattattcagatgtaattaccgtgattattatcgcaactgtattagcgccatttattttaaagaatgcattaaaacgatcagccaacgaacttgagtaaagggggcttttgatggaaaatcatgaacgagaaacggagcaagcgcgggttgataatgttgaaaaacaaattgaccaacaggtagctgctaccactaaagctgttgaagatgctcatcgtgaaacacgagcagttgaacgtaattatagtgaaaatgcatctattaaccgttatgaagttgatgatattgccgaatctcggtcaatgattgaacagcagcgacaattggtttcacgagcagcggaaagtgaatcaattctaaagcaccagttaagaactttgaaaaacttaaaagggtcaccgtattttggccggattgatattcaagatcctggtgaagataagagtgaaacgctatatattggtacttcttccttaatgaatgaagataaaacagactttttaatttatgactggcgggcaccgatttctggggtttactataatggtacccttgggaaagtcaattatgaaacgccagctgggatgcaaaccacagaattaaaaaagaaacgccaattcactattaaggatggtaagatcactaacatgtttgataccaatgaaacggttggtgatgaagttttgcaagcagctcttggaaagcaaaatgaccagtatatgcataatattgtggcaacaattcaaaaagagcaaaatgatattatccgtgatacgcgtagtgatcttttgctagtacaaggagtggctggttcaggaaagacttcagcgatccttcagcgaattgcatacttgctttatcatagtcgaacagaattgaatgctgaccagattgtcctctttagtcccaataatttatttagccactatatttctgaagttttgccaagtcttggtgaaagaaatatgcggcaagtaacattagaagggtttatccggcggcgttttgaaggcttgcaagtagaaacattatttgatcgctatgaagaacggcaaaaacctgaaaatgcttctcatgttgttgctgactttattgaaagtgaatcttttatgacgtcaattgcacattatgtcgagaaaatgacaattgatgatttgcagtttgctgatattcgctttaatggtcaagttttcttttcggctgatcacgtcaaagatctttataaagaattaccattgacgatggctcctgctgataagttagttcaattgaaaaataagttaattcgtgaattgcagcggcgagttaaagatgaagctaaaaaagattgggtagctaaagaactggattcacttgatttacaacaattgcacaacctttatggtaagaagacaattgatgactttaaggatgaagatgagcaatatgcttacctttcgcggcgcttagctaaacgacgcttacgtgtgattgcagatgcgatctataataattactttctcgatttttataatcaatataataagtttttgcatcaagttgaggtacctaagacaattagtcagcgggaatgggcaacaatgatccttgcttttcaagatgagattgaataccatcggctggaattaatgcatgcggcacctttgatgtatctgcgtgatttgatttccgggacaggacaaaatcgttcttttcaatatgtatttattgatgagatgcaagattattcaacagcgatgttaatctacttaaaacacgcctttccccaagctaaatttacggtcctcggtgatagtgaacaggctctttttaagccattgcaattaccggaagagttattaaacaaacttagtggggtattaaaggccaagcgacctaatctaattgctttacggcggagttatcgttccacgacggagattactaattttgcgaaggccttgttgccggatggagataagataatttctttcactcgccatggaaagaaaccacgcttgttagtccgttattctgataaagagagtcagcaaagcttgttagatgagacgcttaaattagctgacgaacatgaaactgtagcgatcttaaccaagaatcaagagcaagccgctggtatttatcaattacttcaccggcaaaaggttgaaaatattcatctcctcgataaggatgcaagtgaattgccaaagggagtcttaattctcccaatttacttagcaaaggggcttgaattcgatgctgttcttgctgcggatgtctctgctaaaaacctaactaatactgatgaagttggtatgatctatacaatggcatcacgggcaatgcatgaactggtccttttaagcaacggctcagttagcgatgcaattaacgagaaagctgggcgtcttttaacgattgaatatcaattgccaaataaaaattaaatttttctattgtctaaaaacgctttcaagaagtgtcgacttatgataatctaatggggtagatatagaaaaaggagatgcttcgccatggttaaagacgaatacacacttgtactagtaaaacctgatggggtaaaaactcgtcatattggagatattattacccgtattgaacggaaagggtataatattgaagctcttaagatgattaacccatcagaagaaaagcttcgtcaacattattttgataaagttgacaaaccattcttccctgaattgttagaatacatgacagaaggaccaattgtcggaattgttgtttctggtactaatgtaatccaagcaattcataatatggcaggagctactaaccctggtgaggctgaatggggaacaattcgtggtgactacggtcgtgaatggcctgatggtaacttgcgaaatatcattcatacatctgataatgttgatagtgctactcgcgaaattggtatttggttcccagaatttgatattaaggataagcagtagaattaaagaagctgaaagaaaaaacaaaaattttctttcagcttctttaatttattcatcacttgccctttgttggcgtttaatttttcgttgtactgccaaggtattgcgttcccaaaagaccccgtcagtgtagccttggatgctaggatcatcctttacttgattgagccggtactgtccccatgcacaatatagaagactttgctcgattccaagataacggcggttaagcttagcggcagtcactaaactcgaaccggaaccagcaaaaggatcaaaaataaagtcattgggattagaactagcaagaataatttttgccagtaatttttctggcttttgcgtagggtgaccagtattttctggcattgaccaataggggattgaaatatcgtcccaaaaattagagggcattgtatcacgaaaattaccgtttttagtagcttgccagtctttagcaaccccatcttgacgataaggggctaccacctgccgtcgttgtttaacttggtcgacgttaaaggtatagtcactcgggttagcagtcaagaaccaaatatcctccatcccgtttttccaatttttctgtgagccccggcccttttctcgttgccaagtaatccgattttgaattgtaaaatttttttcgaggatcggcgcaagtgccatgctagttgcccaatcagaaaagacatagatactagcattttcttttagtaatggctttaagagatcaatccacttttgcgtgtaagtctgatattggctcgtagacatctttttgaagtttaaaccatcatattgtttgttaagattatagggagggtcaataagggcaagatcaacctggtgtggtgctagttgagtcattactttgaaggaatccccgttgataatcttgttggatattgtctggagattatcagttgggtgaataatctggctgaggagctcaggtgaagcctcctcaagcgtgaaatcaattgttttatttctttttgagcgcatattgaccactcctgttcgacgtttagtattattatacttgtcatattcaggattgtcttgcctttttagtaggagttggattaaaattaactatattaagtagcgcgagtcttagcgagggacagttggtgaaaaggtccccaaagtgcgaaatggtcacaacaaaatacataatgagcggcaatgatgattgcaatttaggtggcaccgcgcgaaaagcgtcctatttagtttatatgactaagtagggcgttttgtaatttaggaggaatttaaaatggcagaagaaaaacacgttattttaactggtgatcgaccaactggcaagttgcatattggacactatgtaggttcgttaaaaaatcgggttgaattacaaaatacaggtaaatatgacacatttatcatgattgctgaccaacaagcattgaccgataatgcccgggatccggaaaaaatccgccgtagtctccatgaagttgctctggattatttggcggttggaattgatccaaagaaatcaacaattttggttcaatcacaaattccagcattaagtgaattaacgatgcactaccttaacttagtaactgttgcgcgtttacgcagaaatccaactgttaagactgagattaagcaaaagaaatttggtgaaagtgttccagccggattctttacttatccggtaagccaagcagcagatattacagcatttaaggctgatacagtgccggtgggtgatgaccaagaaccaatgcttgaacaaactcgtgaaattgtgcggacgttcaaccgtatttaccaacaagatattttggttgaacctgaaggagtatttccaccaaagggtcagggacggattccaggactagatggcaacgcaaaaatgagtaagtcccttggcaatgcaatttatctttctgatgatgctgatacagtgcaaaagaaagtaatgtcgatgtatactgatccaacacatatcaaggttagtgatcctggtcatgttgaaggcaatactgtctttacttatcttgacatctttgatccagacaaagaacaagttgctaaattgaaggagcaataccaagctggtggtcttggggatgttaagattaaacgctacttaaatgaagttcttgaagctaaacttgcaccaattcgcaagcggcgcgaagagtatgctgctaatcttgattatgttgatcaagttcttaaagaaggatcagcacgggcaaacgaggtcgcaaaccagacacttaaagaagttcgtgatgcaatcggaattaactactttggctaaaaatataaattgaggaagcgaggctgctaggaaaataagtttttctgcaagccccgttttttttcgtgtctcccatagcagaacatggtaacataaaagagatgtatttatacgaaaaataattaattaaagcggaggtgaaaatggtggaaaacctcgcgattgtagacctcggctcaaactcggcccgaatggcaataacagaaattgctccagacggacgattccgtgaaattcgacgtgtaaaagaaaatacacgtttatctgagggaatgggacgagaaaaaatgttacaagagagtgcaattgaacgcacaattgcggctctaaaacgatttaaaaaaatctaccaagagattcccaatattaaggttcgtgcgatcacgactgctgcagttcggcaggcacgaaatcgtcaagagtttttgaagcgcgtccagcaagaagttggtattcatctgcaagttttatctggtaaaaaagaagcctattatgattacttaggtgtcgttcgaacattgcggcttaaccactgtttaattttagatgttggtggagcaagctgtgaattgatattggtacagcagcgaaaagcacgtaacttgatttctattccggtgggtgctgttaatttatcagagcaataccatttaaatggctatgttcgttcggctgacctttttcgtgcgcaggtagcgatgaacgaacgattgaccaaaattccgtggttacgttatgcgacacgtgtcccgattgttttattaggtggtgctaaccggactttggcgcgtatgacccagtcttaccatcaccatcaccgtcgaaatggttcaattcatgggtatcagctctcctcgcgagtagtatttgctacttatcgggaattgttaaatcgtaacttggcccagcgtaaacgcatgactggtctagaaccggaacgagcagacattatcatcggcggaatgctgcctcttgtaacccttttgcaacgcaacagtgatggtcgggttattttttcagagagtggtgtccgcgaaggaatcatcactgaatatgtaaatcaaaggaagcgacaccatgactgattggcaacacggtttttataagttatctgccgatgatcgacgtcaacaattgacaaaagctcgtcaactgtcccccatcgaagagcaagtattggcaaatacaagttcagatttaggggatgagttagtcgaaaattatattactgattattctttacctgaaggagtagccttaaacataaccgtaaataatcgttcgtatgttgtgcccatggtgattgaagaaccatcagtcatagccgctgctagcaatggtgcacaccgggtaagtaggtcgggaggatttactgctcctcggcaagaccgacaattagtgggacaagttgtgttagatgacgtgaccgataaagcagcagttaaagcatggttattagaacaccaagatgagattttaacaattgctaaccaggcgcacccatcaatgcaggcacgaggtgggggtgtgaagtcgatgaaagttcgcacccctggggactttattagcgttgatttagggattgacgtttgccaggcgatgggcgctaatagcgtcaatacgatggcagaagcggttggaaaatggttaacggaccagggcttccatgttattaccgcaattttaagcaatcttgcaacacagagtctgcaaaccgctacttgtaaagttgcttttcggtacttagcaactccggagatggatggtaaagaggttgctcaacgaattgctcgtcttagtgatcttgcacaagttgacccttatcgagcagctacccataataaaggaataatgaacgggatcgatgcggtcatggtcgccagtggaaatgactggcgggcaattgaaagcggggcccatgcttatgctgctcgtgatggacaatatcgcggattaagtacttgggaaatccaggacggctacttggtaggaaaaattgttcttcctttaccggttggtgtaattggtggttcaattggattaaataaaatgactaagataaactatcatattagtcaaattaagagtgctgaagagttggcggccgtaacagcaagtgtcggattagcacaaaatttggctgctttacgagcattgacaaccactgggattcaagctggtcatatgaaactccaataccggtcattagcagcaagtgtcggagcaacgccagcagaagtaccattagtagtagcacaattaaagcagcgatcacatgttgaccaagcacttgctaaagaaatattatcaacgatcagaaaggaccaagttaatgactgaagagagaattacactaaataaagaaaatcaggcacttcttgatcaggttaatagtctatatcctgaaggtagtgtctttgttcagtttcatggtgacaagtcaggatatgttcgccatgaccaagcaactcaacaaactattcctggtgccttggttattattgtgaccgacttgactgcccccaattacactgcctcacacgaattactacaccttttgatgttgctaaaaggtttcccacaaatctttttccaactgtctcttggtgataaggaactcgatgaacagatgatgattatgtcaacggatttgtataacattgccatgcatcgagtagtggtggcagaacaacgtaagcatggttttattaccgatgagattgaagagcagtatctaaaggggattgaacatacattaactccggaaaaagaggaagatgatgaacggacgttacggttattaacccttttggatgctttggtcttttacggtgatcacctctcaaagtatgaaaaaactttagcagaaaagtacccgcttgcactggccgcggcaaaaaagatgtatgctgagattacaaagaaacccattaagtcaccgttcgatatgcgccggtcaattgttaagatttattctttatttgatcaacagatgcaggaatggggcttaccagccttacacaataacgaatacacaactctttcaccggtattaagtgctcggcaattgcgtttagagatgcgccaagtttttgaaatctatcattctgatatgaaagaacgggggacggataagcgcgcctatgttggtcttcggcggagtgatggtcaaaattcatttactcttccggcaccgactcaaaatgcaccagaagcatttaaaaagatatatgatcaatcagtgcaggaatttcttgaacagaatagcattccatacattgtaaggaagtgagttagatggatgcgacgattcaaaaaacatttgacgacgcaaaaaatattgtctttctaacgggagctggtgtttcgactgcttctggcattcctgattttaggtcagcaaacggtttatatacgcagaatcggaatgcggaatactatttaagtcaccggtattttgctagtgatccagaaggcttttacgaattttgcaagcaaaatttgtattttccagatgcaaagcccaacgtaattcatcaaaaacaggcagccttgacgcaacaggaccgtgcgactgttataacgcaaaatatcgataacttatatgaagaagctggcacgaaacacttgattgactttcatgggaaccttttccacgtttattgtgaaaagtgtcatgaaactgttccagtgagcgaatatttgaagagtcgcctgcatcaaaaggataatggtcccttgcgtccggacattgtgttatatgatgaaggaattaagcaagaggatattatcaattctgtcaaggcaatgcaacaagctgatttagttgtgattgtgggtacctcgatgaaagtatacccatttgcgggcttgctagattaccgtaatccaaatgcaaaggtgattgctgttaatcagcagttattgcattttccttttgactttcaaatggttcaagacgatgcaacaaaattctttgacgaattaaaagtataaaaaagaagctgcagttgtctaaggacaatttccagcttctttttgctcaagtggttattcaaagaaaacgaccttcccatcaactttgaatgggagtgctactaaatgagagtccttctttttagtagcatccttttcttgataaaaaatgtgacgaatacctttgttctttagtagcatttctgatcgctcctttcatattgttcacttgtaaaataacatgttttgaacgtttttcctagagaaataatgaagtatgagaaacgctttcattttaaagtgtgaaaataatgcataatccgttcgtcttttactatcaaaatgaataaaagtgataaaaacaggaatttgagtccttaaaaaatgaatatagatttattttgtggtgtataagaatttgctaagtaatttgatgaggatttttgaggtacgaaagagaggattaaagatgaaaataacgatggggatgacaacttggacggagcatccagtactcattcatgatgaacaacgcccggtaaggcttgatgagtatgctcaacattttccggtggttgaggttgatacttttttctacgctttacctcagatagcaacaattcaaaactggcttgctactgttcccccaacttttcagtttattgttaaggctaatcagaaaatgacattacatcagcgaaatcaggaacgtggcgaattagaacaggtctttcaacaatatcgccgaacaatctctcccttggtagctgctggtcaattaaagacgatattatttcagtttcctccatattttgatgcaactgtgcgtgacttttcttacttacgattaattcgagaatggttaggaaacttgccaattgcagtcgaatttcgtaatcaaacttggtataagaaagaaattttaccgtcagtcttagacttctgtcgtgaactcaatttcacattagtggccgctgatgaaccccataatacgccaacgtccgtaccgtttttgcttgcaacaactaatcccgacttagccatgttgcgccttcatggtcgtaatcgaaaaggatgggaaaatcaaggaaaagaatggcggaaaacgcggactttatatcgatattcgccggaagaactccaattctttaaaaaacaaattgagtccttgcagccgcaacctaaagaactctgtgttatcttcaacaataactcagctaaggatgccgcacccaatgcattgagccttcaaaaaatgatgaatattgaattcgagggattggcacctaaatcgccagaacagcttgatctgttttaggatggagtaagtcctaataaaatgctatactaaatgttaaatcttaattagtaatatcttagaaagaggggcctcatatggctgaacaaaaaccaacttattacattacaacaccaatttactatccatctggtaaactccatattggtaattcatacacaacaattgcatgtgatgcagaagcacgttttaagcgtttgatgggctatgacgtattctacttgacaggaaccgatgagcatggccttaagattgaacaaaaggctgaaaaactcggcatgaagccacaagaatacgttgatcaaatggctgcccaaattaaagagctatggaaaaaacttgaaattacaaatgacaagtttattcggacaaccgatgactaccatgaaaaagctgtccaaaagatttttcaacaattgcttgaccaaggggatatttacaagggcaagtatactggttggtactcagttgatgatgaagaatacttcacagaaagtcagttagcagaagtttaccgtgatgaagacggtaatgtgatcggtggaaaagcgccatcaggtcatgaagttcaattagttgaggaagaatcatacttctttaagatgagcaagtatgctaactggttaatgaactactataaggaacatcctgattttatcgaaccgcaatcacggatgaatgaaatgattaataacttcttaaagccaggactagaagatcttgcagttacgcggacatcatttaactggggggttaaggttcctagtgatcctaagcacgtggtatacgtatggattgatgcattatcaaactatattactgcgctgggatatggtagtgatgatgatagtcttttcaagaagtactggcctgctgatgttcacatggtaggaaaagaaattgttcgtttccatacgatttactggccaatcatgcttcatgcgcttggcttaccattgccaaaacacatcatcggtcatggttggttaacaatgcgtgacggtaagatgtcgaaatcaaagggaaatgttatttatcctgaaactcttgttgatcgctacggccttgatgccacacgttactacttattgcgggcaatgccatttggtaatgatggcgtctttagtccagaagactttgttgataaggtaaactatgaccttgctaacgatctaggaaacttgctcaatcggactgttgcgatgattaataagtatcaaaatggtaaattagttggcactaatgatgcaacgactgattttgatgctgatttagaacaaactgctagtgatgtaattgctgagtataaagaattaatggataaaacacggtttgctgaagcattggcaactgtttggaagttggttagtcgtgctaacaagtacattgatgaaactgaaccatgggtactagcaaaagatgatagtaagaaggatgtattatcagatgtgatgacccatctagcaaagagtttgtggattattgcagccttaattcaaccaattatgccgcatgcaccaaagcaaattgttgaacaacttgggattgaagggactgacttatcattaactgatcttcaatttaatgatttcccagcagaagctcaggttgtcgccaaaggaactccgatcttcccacgtttggatgtgaaggccgaggttgaatttattaagagcaagatgacagcaaacgaaaagaagaaaggaagaaaggcaatggctgaagcaaaagaaaaagcccaagaaacagcacaagaagagaaaacagatggcaaaaagccaattcggattgatgtctttgacaaagttgaattgaaagtagctcaaatcactgctgccgatcatgtagaaggtgctgataagcttctaaaattccacatggatgatggaacagaagaaggccggcaaatcctttctggaattgccaaatggtatccagacccttctgttttagtaggtaagaaagttttgattgttgctaacttgaaaccacggaaaatgcggggcgaattaagccaaggaatgcttttgtctgctgaaaaagacggtaatgttcaagtagtaactgttcctgacaatttagtacctggaatgggcgttgaataaagtgcataatcatcaacaccagcaattggtttatgattcccatacccacctaaatgacgatgcgttttatgatgatgtgcctgcctttattaaccgtgctgctcattatggcgtgacggagatgaatattattggctcaaaccaactattaaatacccgtgccttaaagttgggacaccagtatgataaccttcatccaattattggttggcatccagaagatattgctaattggaatagcgaaaccaagaaagagttatgccaacaattagcagatcccttagttgtaggaattggagagattggcttagattattataatgacgagcattctcctcaccagcaacaacaagaaatttttgctgaacagcttgagtgggcgcgagaactgaaattaccagtttcgatacactgccgagatgcaatggctgacacgtatgaaattttgcggaatgcccacatcgatgaatttggcggtgttatgcatagttttaatgggacgccagaatgggcagagaaatttatggatctcgggatgatgatttcatttagtggtgtcgtaagtttcaaaaatgcgacagaagtccatgaagccgcgttagttgttcccttggaaaagatgatggttgaaacagatgcaccttacttaacaccactcccataccggggaaagcaaaatgaacccggttttactaagtttacggtggatgcaattgcagatttaaagcaggttgatgctggtaaggtggcatataaaacatttacgaacgcccgccgcttatttttggaaaataaagaaagaggcctatgattagaataaaagaagttatagttgttgaaggtaaagatgatactaagcaaattttaaaagcggttgatgccgatacctacgaaacaaatgggtctgcaatttcaacggctgacttggcgaagttgaaaaagttacaagcaagccggggcctaattgtttttactgatccagactttaacggggagcggattagaaaaataatcagtgaagccatcccaggagttaagcatgcttttattaaacgaaaagatggtgtaccaactgaggctcatggtagcttgggagttgagcatgcaacgccagcagttataaaatcagctttggagcacctttatacccaaacaacgacacctcagcaagtttttaagcgagaagacttgcaaaaatggggattaacaggtcaagcagattcacgaaaacggcgtgaaaagctagggcaattactcggaatcggttatggaaatgggaaacaattgattcaccgtttaaacatgtttcaagttgaccgagcaacatttgaacaagcaattaagcaaataaatcaggaggaagatcatgagtaattcaccagaaattggtagtcgaacacgtacccgcgcgataatggaaaagtacgggatccgaacaaaaaagagtttcggccagaatttccttactgatttgaacgtcttaaaaaatatcgttgaggcggcggatattacagctaatgacaatgtaattgaaattggccctggaattggcgctttaacggagcaattagcacaagcggcgggagaagttttagccttagaaattgatcaagatttaattccggtattaaaagaagtattatcaccatatgatgatgtaaaagtgattaatcaagatgtccttcaagctaatttaccagagttaatcaaaaaggaatttaaggatcctagtcgaccaattaaggtggttgctaatctcccttattacattacgagtcccattctaatgaatttgctggctagtcctgttgagtgggcgacgatttgtgtgatgatgcaaaaggaagttgctcaacgactcacggctaaaccaggaactaaacaatatggtgcgttgacattagcgattgaataccaaatgcaagctaaaattgcttttgatgtttcacgaaaagtgtttgtgccagcacctaatgttgattcagcaattgtggtattaacgccacggacaaatccacttccagttcagccttttgataagcaaaaattatttggctttatccggggatgttttgctcatcgtcgcaagagtctttggaataacttgcaaagtgtaattggtaaggatccagcggcaaaagagaaaatgacggccgttttaaaccagctggatatttcgccgcaaatccgtcctgagaaactaaccctcgaacaatttattgaacttgcgaatgctcttcaccagcaaaatctcttgtaaaagatggttgaccgttataaaacattatggtacaattttgctttttgtgtaaaaaaagagtatgctagtctacagtgaggtgaaggagtcgtgcctaatagcattgtagaaattaagaagaagctagatgaacggattggcgagcatgttttagtaaaagcacaagctggacgtaaacgtattaccacccatcacggtattttgagtaagacctatcctgcagtatttgttattcatttgaatgatgaacaaggaacattggatcgggtttcctatagttatactgatttgttaacacgaaatatttcaattgccttcgatgaagcagaataaactgataatttaaaattcatatttataaaataataggagtgggtaaaaatacctttcaacaggaaggcagtttttattcactccttttgctttaggaatagttaggaaacagtagttgcaaggattatagttccgttagtataatttaactaactaaattattataaattaaggagggttgccggatgatagttacagaaaaagcaccagcaaaattgaatttgagtttagatacgccgatgcgatattttgatggttctcctcaatgggatatggtaatggtttcggcagacctggctgattatgtaactgttgagacacaccggcgccctgcaacaattaaagtttatacaaatagtggctttttacccaatgaccaacgtaatttagcataccaagcagctcatattttacgtagtcgttttcattgtaaagatggcgttacaattcgaattaagaagcaaattccagtcgcggccggattgggcggtggctcttcagatgcagcggcagttttacgcgcattaaatagtatttggcggttgggcttgagtttatcagaactggcaaagattgcattaacaattgattctgacgtcccgtattgtatatataacaaattagcccacgttactggccatggtgaaaaaatcgaattgttaccaccgcaacctcattattgggctgtgattgcaaaacagaagatcagtgtttctacgccgcaaatcttacgacaaattaattatgagaagcttcaacatcttaataatgaagcattactgacaaatttaaagaaagaagattggcaagaagcaacaaaatatatgggaaatgttttagagcccttaacgatgaaattttatccagagattggtcgtctaaagaataagatgaaagaattgggggccgatgttgcccagatgagtgggacgggaccaaccgtcttcgcaatctgccatacagaatcgcgagcaaaacggattcaaaatagtatccggggattttgtcgcgacgttcatgttgtaactttgctttgatcatatttaaggacaagaggatggaaagaagtaactttctctcttgtcctttttatttttatgttgcaatcccgcataaagttcgatattatattcattgttctaaatagtaacgattacgattaaaaagagggaaagaatgaaaaaatatattatcggtattagtagcattattgctttgttggttataatacttggtttatcctttgttccatggaaatcgatggggaaaaatcaaaagccaattagagtggtaaccggattgaatttctatggtgaagtagcgcagaaagtagctggcgatcatggccaagtgatttcgtttattgataatgcttcggttgatccccatgattatcaacccaatactaagcaagcccagcaagttgctaaagccaatgtagtaattgaaaatggtcttggttacgatagttgggtaaacaaactcgttaaatcaagcagtaaccataacaagattaaagtaattaatgtggcatctttaaccggcaagaaagatggcgacaatgagcatatttggtatgcgcctgagacggtcgaaaagttagcaaatgaccttgcaactcaatatggtaaaattgatccgcaacacgctaaggattaccaaaagaatgcgcgaaaatatttagcttctcttcaaccacttaatgaagaaattgccaaagtgaagcgccaggtaaatcctaacaataatcgtgttgcagttagtgaaccagtttttgattatgccttagagaatgttggttatcaaattatggacaagcatttcgaaaaagctgttgaagatgggaatgatccatcaccaaaagatattgaagaaattcaacaagcaatcattaatcaccaaattgccttctttgttgataattcgcagacaagtgataaagttgttgataatttagttaaacttgcccctgaacataatgttccagtattaaaggtaacggaaacaaagccgaatggggatgactatatgcagtggatgctcaagcaataccaagcattgtctcgcattcaacaaaaggagaattaagaagataatggcagttgtatcagttgatgatttaacgatcgcttatggaaatcatactgtaatcgatcatttaagcttctccattaatgaaggggattttcttgtcgtggttggtgaaaatggggtaggaaaaacgactcttgttcgctcaatgcttggttttttaaaaccgaaaagcgggacaataactattccgcaaagtacacgacttggctacgttcctcagtttcgtaatattgacgaggaatacccactatctattcgcgattttgttgctttaaatactaaaccacgccttttaccatggctgactaaaagcgagcgaaaccgtgttgaacggatgattcgtgaaaataacctaacaaagattgctgagcggccccttggtttagcgtcagggggtgagaagcaacgagcatatcttgctcaagctttattacccaatcctaacctccttattctggacgaatcgacagcaagtctggacaatgaaatgaagtatgaattgctagacctagtaactcgttttcaacaaaatggtttaagtgtaatgtttattactcatgattgggatctagcagaacaatatgggacccgtttcttatatctctctcccggttcttattccactgggccaattaatgagttacccagtccggtaaagggggataaaaagtaatgttaactttaagttttatgcgtcacgcatttgtcgctagtacatttattgcgattatttgtggaattattggagtttttgtcgttgcacgaaatttatcattcttaacgcataccttgtctgaaattgggtttgctggtggtgcttttgccgtttttgctggatggccagcgctaaatgggatgattctgtttacaatgttaagctcagttattgttggacaaatgagtataaaagaatcacggcgagaagcggttattagtgccgtttcagcgttgttcattggtttaggaattcttttcttatctttgagcagtcagtcagctagctcagcaacaagtattttgtttggtagcgtggttggaattagtttgaatgaggtctggcagcttgtctacctttccattcttgttttgatcattttgctattgatgtatcgtcgccttaagtttgattcctttgattcaattggggcgcaggtcagtggaataaatcaaacagtgatttctgttgtttttcttttactacttgctttaagcgttagtgtcgctgctcagattgtcggttctttgctaatttttattctcctaacgttaccagctgctagtgctaaatactttacgcatggtgtcgcacggatgattattttagcaattttattttcactgttagggacatggcttgggctttttctcggttatttgacagattggccggttagtttctttatcgcagtgattgaagttatcatctataccacagccttgatttatagtaaatttatcgaatcgaattagactgtggcttaagtaggtaaacaacatagtacaacaatggtcttcaacgcccgacaaagtgttggagactattattatttgtggggctttcagatgctagcttcgtggcgacaaaatgccccctatctcgtactcttttttctcagtaaatactaaaattttgccgaaaatccgaacattttatgttaaaatcaatgttaattaatcctttttgaaaggcagagaaagaacatgaaaattagacggagtaaccgattggtggatatgacacgttacttgcttgaacatccgcgatcattagtatcgttgaagttttttggtgagcgttacgactcagctaagtcatcaatcagtgaagatttaggaattgttaaacataccttccaaacttggggacagggacgattagaaacaattcctggtgcaagcggtggcgcggtgttaacgccattttattctaaggaaaatgctcaggcggccattgataacttagttgaccgggttaatgatgactcgcgtttgctaccggggggttatgtttacttatcggatttaatcggccaaccagaaattttgcggcagatcggtaagttaatcgctactcaatacgttgatactgatgttgatgttattatgacagttgagactaaggggatcccgattgctcaaagcgttgcgatgtatatgaataaaccatttgttattgttcgtaatagttcacacattactgaaggacctactgtaagtgttaattacgtttctgggtccgtccaacggataaagaagatggaattgtcccgtcgtacattatcagctggggcgaatgtcttggttgttgacgactttatgaagggcggcggcacgattaacggaatgaaatctttgattaaagaatttgatgctaacttggttgggattactgtttttgcagaaggtcgtccggtaaatgggcaacggttagtcgataactgtacttcattaatcaaagtggaaactaaagatggcacggagaagaagattgcagcacaagcaggaagcttcatggaaaacgtgtttgataagaaagtggagaattaggaaatgacaaaacgtaatgcaattattttagctgctggtaaaggtacacggatgcgctcaaagctatacaaggttttacaccaagtttgtggtaagacaatggttgagcatgttttaactcaattggaaaaggccaagattgataatattattacaattgttggtttcggggcggaaacagttgaacagcaattgggacaccgtactaagtatgcgctccaagaacaacagcttggaaccgggcatgccgtaatgcaaacaaaagaccttcttgcaaatgaagatggcgaaactattattgtcagtggtgatactcctttatttacggctgagacttttgaaaaactctttgaatatcatgaacagcggcatgcggcagccactattttgacttctattgctcctgatccaactggttatggccggattgtgcgaaatgatgttggaatcgttgaacgaatcgtggaacaaaaagatgctactgttcaagaacaggcaattaaggaaattaataccggagtttactgttttgataacaagaaactctttgctgcccttagcaagatcacgaatgataatgcccagggtgagtactatttaactgatgttattggcattttaaagcaagaaaatgagatcgtaacagcctacaagatggataactttgacgaatcaatgggggtaaatgaccgagttgcccttgcacgcgcaaacaaggtaatgcgtaaccggattaatactcattggatgcgtgaaggggtttcaatgattgatcctgaaacaacttatattgatgctgatgtcaagattggtcgtgatacagttattgaaggtggcgttgtaatcaaaggtcatacagaaattggtaacgattgttatatcggtgctggttcacggatcactgattccaagattcacgatggggttaaaattatttcgtctaccctccaggaagcggaaatgcacaatggcagtgatattggtcctaatagccacttgcgtccagaagcagaaattggcgaaaatgttcatattggtaacttctgtgaggttaagaaggcttatattggtgaaggaacaaaggtcggtcacctgacttatatcggtaacgctacgttaggtaaggatattaatgttggctgtggagtagtctttgttaactacgatgggacaaataagcaccataccaatgttggcgaccatgcctttatcggtagtaacagtaacttagtagctcctgttaatattgcaaaagattcatttgttgctgctggttcgaccatcacagatagtacggaacaatatgacatggcaattgcgcgggcacggcaggttaataaagaaaattatgctaagaagctaccatggtaacttgctttttgcctcactaatttatattatgtaagtggtagtagtataacatttattaatcagcggaggacctaatgacacagcaatattttgatcaaaatttaaaaatctttgcgttaaattcaaatcgtcccttagcagaaaagattgctaagcatgtcggggttgatttaggaaaattatctgttaatcgttttagtgatggtgagatccaaattaatattgaggaaagtgtgcggggagacaatgtttatgtcatccagtcgacttccgccccagttaatgacaacttaatggagttattaattatggtggatgcgcttcgtcgtgctagtgccaagacgattaacgtggtgatgccatactatggttatgcccgtcaagaccgaaaagcacggagccgtgaaccaatcactgctaagttggttgctaatatgttgcaaaattccggtgttgatcggattattgcacttgatcttcatgccgcacaaattcaagggttctttgatatccctgtcgatcatttgatgggtgctccgcttttagcagagtattttatcaaccagggtgttgctgaaaatgcagttgttatttctcctgatcatggtggagtaacacgggcacgagcacttgccgagtttttaaaatctccaattgcgattattgacaagcggcgtccacgggcgaacgttgctcaaatcatgaatattattggagacgttaagggtaagaagtgtattatgattgatgacatgattgatactgcgggaactattagtttaggttcgcaagcattaatagatgccggcgcagaagaagtctacgcatcatgtacccatgcggtattatctggcccagcaattgaacgtttacggaatgcaccgcttaaagaagtggttgtgacagattcgattcaattaccaaaggaaaaacaaatcgataaaatcaagcaggtatcggttgctccactaattggggatgcaatcaaacggattaacgaaaatcgtcctgttagtccactctttaaacaggttttccaaagtgcacagttggaaaagaagtaatgcttaagcaaactgaaattaataaataaagtaggtcggaaggaaaaaatatttttagtttctttcggcctttcttattttccgtttctgttttaaaagaagataaagatttaggaaaggcaaacagtcattatcaattcatgttataatacgatgtgaaataaggaggagaaaaatgacaacaattaagtttttcaaaaaagcaatggttggaacagctgcagtcgctactatctttgccctcgctggttgtggtaaacaatctgcgtcaagtagtgatacaagttcttccagcacatcgtctgtccgttcttccgaaagtaaagcttcaaaggcttatcgtacagctaataagcttatccaaaatcatgactatgaaggagcatatgaacaattaagccaattaaacgatcataatgctcaaacggaagcacttgctgatgatttacagagctatatgaatgctcaaaaagcatatgaaaatggcgattatgatggtgctaagaacaatttaaaatcacaaaagtcgactagtacggcaatgcgcaatgcatatgctgacttacaaagcaaggtaagttctgcacaaggttccacgagttctcaaacttcatcatctaccaatagcaagcaaacaaataagcaatccagttctacaagctcagcaacgcaacaatcatcctctgctgctaaccaagctgcatctgatgcaactagtgataatgtagtccaacaatttgctaacaagatgggctttagtggctcccaaggttaccaaattatgccaacaggcaaggatggcaatgtttacaagtttgaagttcggcaaaacaatagtgataacactgttgcaagcttgattggtatttaccaatataacagtcaaactggagcggtaacaaagatcgcttaatatataaaagatgacaaaaaataaaagcaagaggtgtaactttttcgaaagtacgcttcttgctttttatttctgtctttacttaagaacatattcttcaattgcttttccaacaccatcatgattattatcagcagttgttacgtcagcgatctttaatgtaccgggaattgaatttcccattgctacccctaagccggcatattcaatcattgaatcatcgttttgcgcgttgccaagagccattacttcatcttttttaattccgagttcttcactaagtaattgaagagcatttcctttacttgcttgtttattcatgaattccaaataaaagtcttcgctgcggacaatggaaaagcgatcacgcatttctgccggcagttctgcccatgctttgtcaatttgttctttagtatcaaccatcattgccttagcgattacgtattgatcttgcattttagaaagttcttcaaaggtgcggtaacggattggcatacttacaaggtctgactcgtagactgtatagggacttaaatctcggttaattgtatagatgtaatcccgggtttcaatctgggacttgacaccctctttaatacaataagtttgccagtctgcatagtcattgaaaggcatagtgtagtttaccaagacattcccactagttgattgggccaacgcaccgttaaagctaataacaaattcattatctgaatcatttaagtccagttggtcaaggtatgcctttacgcctgtcatgggacgtccagtgcataagacgatctttactccctgcgcgctggctttttttattgcggcaacagtttgtggtgtaatttggcgttggtcattgattaatgttccatcgatatcgattgcgactaatttaattgccattatttttgctcctttgggttgataatatgattatttttgatatagccttgaaattcttcatagattggttcaaaaatttcaatattgtttcgcgtttcaagcatctcttttggaaaaaagaaccgttgatctccggcttctcgtcccgacacgctggcgaccaaggtactaacttgggataactcaataaaatcgccattaggttggagaagctcgatctgcgtttgggtattagaatcttgtggatgataagtatcgtatgggagtttaaagctatcgttaactgcggtgtagtactggctattaaatccagcagtttgaattagctttcgtaaagttggcaaaagcttttgtgtattttgatcataaatgactgatttaaatggtcggcggttaagaaaacgactcgcaagatcgcttaaaatatcatcacgagaatgggtccaatgaataaaataagtagttaagacaccatcgtcaagcgccaaatagtcatccagggtgaacttaccattaaaaaatggcatcagcatatgaggggtgaagtcaggttcaaagtcatttgggtgctggtaaatatattttgcccgcattaagaggtggtccaagataacttccattgaacgggaaactgggtggaagtagacttgcagatacatctgaagccgactgataatgtaatcttctaccgcatgcatccccgaaatttcaaaggcaatccccctcttaaccggtcgcataacatgaagaacacgatcaagatcaaactttccgtagtttgttcctgtgtaatacgcgtctcgttgcaagtagtccatccggtccgcatcaacctgacttgaaatcatttgaactacttgtggattttcataagtatggtcgatcacactagcaacttgatgggggaagtcaggtgaaacccgttgtaatatcttattaatgttagtgctgctatcggtgatcaactgacgggtaatttgctcatggtttgtatggaaaatatgttcaaatgtgtgggaataaggaccatgccctaaatcatggaggagggctgcgcataaagtaaccggtcgttcgtgatcatcccataggccgtcgccaggatgctgactaggatagtttcgctgaaaatagttgcacatttggcgggtaatttcatagacgcctaggcagtggccaaagcgggaatgctcggcgccatgaaaggtaaatgatgaagttcctagctgcttgattcgtcgtaatcgttgaaactcaggagtattaattaagtccataataatttgattatcgacaataatttgtccgtgaattggatcccgaaaaaccttttcacggcgaagtttttcatcgtaaaagtgattcatattaatcttctttctctaaacgttcttgtaaacgttccatgctgattagttctttactgagagttgatataaaattaggcgaccacattaagttattaaggctgtcaggagcaatgatttgaacgactgattggattcgctggatcgcatcctgaacgcttaattgcgtgttgagggctttagagatagttgtcattgctcccggccaaacatctggaaaatgccacttgttttgatcttgttgcagacctgtatcatagaagtcacgaattagcttaccccgatcctgctgattaccacagacgcttaagtaaagcattactgtaactcccactttgttccgtcgttgagaaattccaccaatcttttggccgttaacgctaatatcgaagcttcctggacagtacgaatacgtgatttcaccagtggcaatttccaggctagggaaagctgcctgaattaggttgaccattcgctggtatgcttcatcaatagttaattcatgatcttcgaggtgccatggatagaaaattgataggtttaaaataccgtcgtcactcacaactgctaatccccctgaattacgcatgaaatagtggaaaccgcggtgcgtaagtgaagcaagggcagttgataaatgcggtaatcgttgatcttttaatcctaaaataaccgtatcctctaatgtccaaaaatgaaggaggggaaatttgagttcgctagctgaacgtaacaaagcgttggtatagatgaaagacgaaagattatccgctggagttaaaggttgaataaactgttgaaaacactgattcttaaaattaggcatcgtacttcttcttttctgtgaaataatatatctatattatacaagaactcatgagaacatggacgtttcacggggtatttatccataaatttgcgagaatacccccacttctataagtaggggatgaatcgctctcttaaagcacgttagtgctttttcttttgttctatgatatatttagtgtatatctataaaatgtggtgataacaagagaattagatagaaatcagcattcagtatacttacttaattaccatttggtaatggtggttaagtatcgtcgaaaagtaattaacgatgaaatatctgaatatcttaaacattgttttgtagttgtgggacaagcatacggcattaatttgcaagaatggaatcatgatcaggaccacgtacatgttttgtttagagcaacgcctcatacggaaatggctaaatttttaaatgcttacaaatcgtctagctccagaatggtcaaaaaacaatttccagaaatcaagcagtatctttggaaatcagccttttggacacaaagctattgcttaattagcactggtggagcgcctttagaagttttaaaacgatatattgaaagtcaagggagaaaataatggttctaaaagccgttaaaatgcgcatctatccaaattcagcacaacgaaatcagctctggcaaaccttcggttgtgttcgttttgtatggaatcaaatgcttaatatgcaaattgaacggcgcaagaacaatccggaagctaaatttgtgaatgcctttgggatgaataatctgttgaaacaacttaaggttgagtatccttggttgaaacaagcagaatcaactgctttgcaaagtgctaatcgcaatttagccgatgcttttcaacgcttttttaaaggtcaaaataagttccctcgatttaaatccagaaaatattctcagagctacaattcaaagtacgttaatggcaatattaaagttttagattgccatcatataaagttaccaaaactcggtatcgtctattttagagctggtcgattgccaatgggtaaaattaagaatgtcactgttcgtctgaacgttgctggtcaatattacattactgttttagtggaaagcgaaaaccaaactcttcctaaaacaagtaaatatattggtggcgatttaggacttaagtcattacttaatctttcagatggatgcaaggaaccgatcaatcattttgaagacaaataccgtaaaaagttgtatcgttgggagaaattgcgtagtcgtcggttcttaaaggcccagcaggaaatcacctgggatcatcataataaagtgttagttccacggcaattagacgattttaagaattatcagaaagctcgtattatggtggcgaagtatcggcaaaagattgccaaccaacggttggatcagctacaaaaattcactactaaattggtcaaaaagtacgacatcattgtgttggaaaaacttaatactaagggaatgatgaaaaatcaccatttagctagaggaatcgctaacgctagctggtcaaaattagtagatatattgcaatataagtgtaactggtacggtaaaaagcttattcaggtcaatccgtcatatactagccaaatttgtgctaattgtgggaagaataatcatcggttaggattaaataaattggaatggttagcggtacgtgagtgggattgtccaaactgtggtaaacatttagatcgtgatattaacgctgcacaagttatcttgcaaaaaggattagctatccgatagataaagttaggctcgggacgagccttggttaatagtcgtaacctctgcttgaaggttcgttcagaatcggtagggtaagtatgtgatgtttccagaatctcccacttcaagcattaaaccgtaggtttagataagcgggagtagttcaatagtaaaaagagtataataatgacgataagcaaagtgaaaggaggagtttattatcaagagcgtaattcctgttcatgtgaatctctcaacgatcattgatcaaagtggacagcaagaaaaatttacctttactgaagaaggtacttttgtcgaaatgaatggtaagtattatttaaggtacattgaacaccaagacgggcaagaaacgccggtgcaaattaaatttgaggatgagctgatccgcttaagaaggcgtggaaatgtcgaaacaaacctatttttggacccgacacaagaaactatcatgcggtaccaaacagaatacggcatgattaaaattgatgtgttgacagaaagtttggaaaaagacgttgatgtaaaggctccggctggtcacctttctgttaagtatcaactaaaacaagcgggacaattaatagggagttaccaactagaattgcaatttgctgcttaatattgtatgatgtagtttagactttttgaagggatgtgcaccaatttggatttaaaggtttttgacggtcaggacaaatcagaactttcaatgattgaagtcgcacacgctattttagctcaccatggaaaagcaatggcgtttgttgatttgaccaacgaggttcagcaatatctgggtaagagcgatgaggaaattcgtgaacgtcttgcacagttctatactgacttaaatgttgatggcagttttatttcccttggtgacaacacctggggtctgcgtgcttggtacccattcgaatctatcgatgaagccacagttggtgaaaacgaagaagatgaagaggatgatcgtccaaagaagaagcggcgtaaagtcaatgccttcctcgcagacaccgatgacgatgacgatgtaattgactatgacaatgatgatcctgaagatgaggatcttgatactgacgatgatgccgattctgaggatgattatgatgacgacactgatgacttcagtgacgacgatgatgatcttgatgatggtattgaaggtcagctatcagaattacatgatgaagaagatgaagacgaggatgacgaataattttcaactttgtgcttgactattatttattgaccctgtattatctttcttgggcgcctgtaaagacaggccaataagttcgtagataaataagctccctgtttcagtgttttatttgaaatagggagttttttctattatcacacccgccaaatataaaaaaggagtagacgacaatgacgaaatacatttttgtaaccggtggagttgtatcatcattaggaaagggaatcgttgctgcctctttaggacgattattaaaaaatcggggcctaaagattgcgatccaaaaattcgatccttacatcaatgttgaccccggtacgatgagtccataccaacacggtgaagtttttgtgactgatgacggcacagaaactgatttggaccttggtcactatgaacgttttatcgataatgatctcaataaatattcaaatgttacaacgggtaaaatctactctgaagttcttcgtaaggaacgccgtggggattaccttggtgggacagtccaagttattccacacatcactaatgccattaaggataagattaagcgcgctggtgaaagtactgatgctgaagttgtaattactgaaattggtggtacagttggggacattgaatcacaaccattcatggaagctattcgccaaatgaaagaagaagttggtagtgaaaatgtgttgtacatccacactaccttagtcccatatcttcgtgctgctggtgaaatgaagactaagccaactcaacacagtgttcgcgaattacgtggtttaggaatccaacctaacattttggtggttcggacagagcaaccaattactgatgatatgcggaagaagattgccttattctgtgatgttgatcctaaagccgttgttgaatcaatggatgttcatactctttacgaaattccgttaaacttacaaaagcaaggtatggatcaattggttgtcgaccactttggtttagaagtaccagaagctgacatgacagaatggacagaaatggtaaatcatatcgaacatgacttaactaagaccgttaagattgcgatggttggtaagtatactgacttacaggatgcttatatttcagttaatgaatcattacgtcatgctggttatcctgtaaatgcaaaggtaaagattgaccactttaatgctgaaaacattactccagaaaatgttgaagagaccttgaaagattacgatgggattcttgttcctggtggttttggaaaccggggagtagaaggaatgatcactgcaattaagtatgctcgggaaaatgatgttccttacctcggtatttgcttagggatgcaaacagcatgtattgaatttgcacgagatgtattaggttacactgatgcaaactcaactgaatttgatccaaatactaaacacaatattattgacttgatggcagaccaagcagacattgaagatatgggaggaacacaacggcttggtgcatatccatgtaagcttaagccaggaacagttgctgcagcggcttatggtaaccaatcaatgatcagtgaacgtcaccgtcaccgttatgaatttaacaacgactaccgtcaagaaatggaaaaccatggcttggttatctctggggtgaatccagatcggaatttagttgaagtagttgaaattcctgataaaaagttcttcgtggctgctcagtaccacccagaattcaagtctcgtcctaatcacccagaaggattatttgctgcatttgtgaaagcagctgctgaggacaaataaaaatttaaattgtataatatatttaatacaagagatgggggcaagaatgtcacttctcttgttttttgtgtgcgcccggcatgggtattagctaggcggtgagagtccgctatgggccgtagtagtcggaaccatgagctgaggacaagggtgtccactgtgaggtggaatctgaaggaagtctaaggcaaagtactgcaccgatgaacaagaagtagctataaggctggaactaactggataagactgcatgacaagttaaagtccaacactactcgaagttactttcagtaaagctaccggtgacatggtacgaaagttaatatccttacccggggggatctggcctacacgtttccgacaagaggaataagtttaatttccacagaaacaagcggtgcagtgatgtagcgttgagtaagccagaagtcagccgaggtcatagtagtctgagtaatcagatgaaggactgaacgacaataacttgtaacttatatcggaggtgtaatcaggtgcgacaatcgcagaaagcagaacaacaagctgaccgcttgtcgaggataggtttggaaaaccgaaagtacacaagggcgcgtagtaccgattatggtgaaggtaaaggtatgagtgtcactatccaagacttagtcttggaccgcaataaccttaatcaggcttatttgcgagttaagagaaataaaggggtagcaggcattgacgatatgacagtcaatgaccttctgccatatctcagagaaaataagacggaattgatcgctagtttgcgtgagggcaagtataaaccagcaccagtcaaacgggtagaaattccgaagcctaatggtggagtaagaaaactcggaataccaacagtggtggaccgaatggttcaacaagctgtggcccaaattcttacacctatctttgagcgtgttttctctgataatagttttggcttccgccctcaccgtggggctcacgacgctattgcaaaagtagtagatctttataatcaaggttatcgaagagttgtcgacttagacctaaaagcctattttgataatgttaatcatgacttgatgattaagtatcttcaacaatatattgatgacccatggacactaaggctcattcgtaagtttctaactagcggagtcttagaccatgggcttttcgctaagagtgaaaaaggaaccccacaaggagggccattgtcaccaatactggcgaatatctatctaaatgagttggataaagagttgactagacgtggtcaccactttgtgcgctatgcggatgattgtaacatttatgttaaaagtcaacgagccggagaacgagtaatgcgaagcattacccagtttcttgaaaagcgattgaaagttaaagtgaacccagataaaaccaaagtcggtagcccgctacggttaaagtttcttggcttttcgttgggtgtagagcacaatggagcctacgcccgtccagcaaaacaatcgcaacaacgagtaaagaaagcattgaggttattaactaaacgtaatcgtggaatatctctgacaagaatgtttgaagaaattcagcgaaaaatgcgtggatggcttcagtactactcaattgggaaactaactgactttattcaacgccttgacaagtggttgagggcccgaataagacagtatatctggaagcaatggaagaagcttaaaactaaggtaactaacttacagaagctggggctgtcccagcgtgatgcatacgtcttcgctagtacccgcaagggctactggcgaactgcacacagtaagaccttgagctattctctaacaaatagaaaactggaacaactcggacttatgaatatgtccaagacgctccagtcaattcaaagtgattaagttgtcgaaccgccgtatacggaaccgtacgtacggtggtgtgagaggtcgataattgaactaatcaattatctcctactcgatttagtagaattgttaaattttaagttaaatatgctaatttttggcctgaccttatgattttttttaagattatttataaaaggttgtaattctcttgatatttcattatcattacagttgactgttttgtaactgaaataatcattaacttagcttaaatgaaaaacagactaaaatttttaagtgaggaaacgcagaaatgaagaaaatgatcattcaaggaggaaaccgtctttctggcgaagtcacgatcggtggtgccaaaaatagtacagtggcattaattccagctgctattcttgcggatacccctgtagagtttgacacggttccagatatcttggatgttcacaatctgatgattattttggagtcaatgaatgtaaagtccgagtttagtcacggagttttagatattgatccaacacaaatcgtagaagctgaacttccaagcaaggcaattaaaagtcttcgggcttcctattactttatgggtgcattattaggtcgtttccatcgcgcgacattaacatttccgggaggcgataatatcggcccccgcccaattgaccaacacttaaaagcatttaaagcacttggagcaaccgttatcgaagaaaagggtactgttcatttagatgcgccgaatggcttacatgggtctcggatctttttagatatggtatcagttggtgcaacgattaatgctatcttagcagctgttcgcgctgaaggaacaacgattattgaaaatgcagctcgtgagccggaaattatcgacttggcaacattcttaaataatatgggtgccaaaattcggggtgctggaaccgatactatccgtatcactggagtaaagacacttcagtcaatgaatactcatacaattattgctgatcgaattgaagcaggaacatacctatccttggcggcagcgcttggtgatggggttatgatccataatgttattcctgaacacttagaatcatttaccagtaaaatgattgaaatgggtgttgaacttcaaatcgatagcgataagatttatgtaccaaaatccagtcatttacatccggttactgttaagacaatgccattccctggttttgctactgatttacaacaaccgcttaccccattgatgtcacttgctgatggtgatagtacgattgttgataccatttatcccaagcgtgtaaagcacatttcccaattacaaaaaatggggatgaagattgaagcacatgatgggatgattatcgttaaacatacagaaaagcttcatggcgcagaggtctctgcaggtgagattcgtgccggagcagctttaaccattgctggattaatggcagatggacagactgtaattaataatgccggaaatattttacggggttacgatcgaattgtatggaagcttaatcgccttcatgccaatgtttctattgaggacgattcttcagtaaaaattggttagaagttgcgtacttctttaaatcgtggtatcctgttaaagttgattatctatgtttcaggcaatgattcatggcaaaaggagcgtaataaattatgaaacaaggaattcatccagattatcatccagtagtttttgaagattcatctactggttacaagtttctctctggctcaacagccacttcaagtgaaactgttaagtgggaagacggtaatgaatacccattaattcgggttgaagttacttcagattcacacccattctacactggtaagcaaaagtttacccaagccgacggtgctgtcgacaagttcaacaagaagtacggtctcaagtaatcgaacttcttacaattcaaaaaagccgggaaaagcgaaagtttttcccggctttttttgaattaagtccaataaatcattattaacgttattttgcgtctttaagtattgatctttctctgcgtataatattgataattgagaaagtgggggggctacctatgcatgaaaaaattattaatcgaataattgccctgcatcgttattctttcgttaggataacccggcagacattaattatgatttttcccattgtttttattggaacgatggcaaagatgattttaaaaactgtttttaaaccagatggctttatttataatgttgcttttcttgatgttataccacagaacgtgttgcgggttattcaatttgtattaactagcattagtcaattaaccttagggattctgggaatttatactgtttatatggcagcaaagtttacggcgaaaaggtatcggcgagacggtaaatttgctggaataacagctattctgacccttttactaatgtcttatcgttatggtaagttttccccacaattttcacttagcttttaccaacggctccttagtggtaacagtttgttaatcgttttaattcttggatatggagtcggtcagctttaccggtggttaactccaccaaaagatggtgataataccaatgcgttgccgttattgaaagaacgatcatttagttcaatgctgccaatgacaattagtcttatttttggagtgacggttgctcttttcttaaattccaacacaatctatcatgcttggtcaacaagttactccacgttagttacgactgcccaagagcatcggcaattatggctgacgttattagctacgatggggttaacaatatttgattggttgggattaggcgttccatacacctcgatggcattaacatctggagattcatttacggctaacttgaactatgcgctcgctcatggaactccgtggaatgtaccgtatgagtttttaggcagttctctttataattcatttgctaactttgggggcgatggattgatccttgccttgatagttgccattctgttaacttctaatggctcctatatgcatcgtgttgcacggtggacggccttaccaacattatttaattttaattatgcggcaatgattggcttaccggttgtatttaatccattatttctgatcccatttgtcttcttaccgattgtaaacattctccttgccagtttagcgattgcgattcacttaataccttcaacgccttacccggttttgcaggggacaccgggaccgcttattagttttttggggacaaatggtaattggggaattttgatttttaccttggtattgcttttaatcgatatcgctgcctatatcccctttgtaaaaatggccctagttgttgaaaatcgcttaacattagcagaacaggacgtgatcagtcatgaaaagaatgactaaatcaattctccatactcgtttagtattgattggcctaatattgattttagtcctaatggcaattccagcatatttttggatgaaagatacaaataaatatttagctgcccaacataattctagaatgtcaccgataattatggttcctggaagctcagcaacacaaaaccgctttaatccacttattcgtaaacttaacgaagatagccctaaaaaacatagtgtgttgcgcttagaagtaatgaacagcggtaaaattgtttcgcaaggatggataaatcgcggcgataacgagccgattatcgtgattggctttgagaataatcgcgatggctatcaaaatataaagaaacaagcgcaaatggttaatcaagcctttgaacgattgacggaagagtataactttaataactttaaggcgtttggccactccaatgggggactagtatggacttattggttggaacattactaccctgaatataaagatgcgattacaattaaaaggctaatgacactaggaacgccatacaactttgcggagtcttctgttagccatccgacgcaaatgttttctgattttgtaaagtatcgaagtcgaatccctaaaaacttattagtttattcggtcgcagggacagaaacttatacatcggatggtctcgtcccagaaggaagcgtcgatgccggtaaatacatttatcaaaaacaagtggcccattatacgagaatgacggtcacgggaaaagatgctcaacactctaacttgccacaaaataaacagattgtacggttaattgaagagtatttgcttgatccaaatgacaacggtaatcctaattcgcaaaataagcagagggctactcaaaattaattaagcaggttatactaagttcataataaaaagtaaggagctcaatatcgtgaaaaaagataaaaagcgatcatttgaatggttacggtggacagcggttgttgtactgttactggtatcagttgtcttaatttttaaccaacagattaagtcttacttagtagggagttataaacctgagattactcggcaaacggttcaaagcaaccaaaagaaaaaagcaacctatgattttcaaagtgtcaaagatcttaacttgcaaacagctgccaaggctcgtgcaaataagcaatcgattaataccattggagcaattacggttccggctattaatatgacgattccaattgctaatggagttgataatacaactcttgcgttagcagcaggaacccttcgtccagacatgaagatgggggaaggcaactatgcgttagctggtcataatatggcccatgggagcaaaatcctcttttctccattgtactatcatgctaaggtagggcagatgatttatatcaccaacatggatcgcgtttatgaatataagatttatcaacgtgaattcattgcggcaacccgggttgatgtggtagacaatacgccggaaaagattataactttgattacttgtgacgctaccggggccaatcggttgatgatccgcggtaaatttgttaaatcagagccatttacgaaagcaccacaaaatgtgcaaaagaattttagcgaaaaatatacgacaggtcgttaaagggaagggggaaataatctcctcgacaaggcggtgggctaagctagagcggcacgggctaattatcgttcgtacttagcctcgagccttgtgacgacgcgaagctagtttcatgttatcttactattgtttgtgaaaaccattgaggctgagagaaaaaattttcttccagcctccttttttattttgtggattttgcctgtatttgtaatccattccaaattaagaaaaacacaatgacgataaaaaatagccaaattaaaataaattttaagtaaacagatgagcgaacggacaggaatgccaccgtttgctcatttttttgctgtaaataaatttcttgactcttttttaggaaccgcataagaaagagatacattgaatttaaggaggcaaagaaatgcgcaaaccgtttattattgcgaactggaaaatgaataaaaacgttcatgaatctgttgcgtttgttaaagcaattaaagaaaagctcccggcagataaagaaattgggatcgccgcgcaagcagtttcgctatataacatgaaaaaagtggcgagctcttccaacttacaaattattgctcaaaatgcatctgctgagttagagggaccatatactggagaaattagcatgcgaagtttagcagatgcgggcgtgacatacgtgatgctaggccatttagagcgccgacgcctttttaacgagagtaatgattcaattaatcaaaaagttttagcagccctcaatgctggtattattccaatcatttgtacggatgaagagatggtccaaacagaagttaacggacaaattcattatgtatttcgccaactaaaaagcgtccttaaaggggtaccagctaataaactatcacagattgttatttcgtatgaaccaagttgggccgttgggagcacgcatcaagcaaatccagacattgcggaagagggatgtcaggcaattcgtcaaagcctggttgaaatgtatggtaatgagattggcgagcaagtccgaatactctatggtggcagcgttaatcccgagaacattggtcaaattatgagtaaaccaaatgttgatggggcgctaatcggtcgcgcaagtctcgagattgaaagtttcttacaaatgattaattatatcgaattagcgagcaagcagaagttacaggtaatttaggaggaagaataatggcttactttgataacggaaacaaactttttgatgacgcacggaagaaccaatacgcaattggggcatataatattaataatcttgaatggacccgggccattttgcgggctgccgcggagactaataccccagtactgatccaagtttcaatgggagccgccaagtatatgggtggttataaatttgttaaagatatggtcgaggaccagatggatgcaatgggaattaaagttccagttatcctgaatcttgaccatggtgactatgatgcagcgattgaatgtattaacttaggatattcgtcagttatgtttgacggccataagttaccgattgaagaaaattacgccaaaaccaaagagattgtccaattagcgcattcacgcggcattgcggttgaagccgaaatcggtaaagtgggagaaaatcaggataccagcagtggagaacttgctgatgttgaagatgcaatggcgtttgcagcaatgggggttgaccgtcttgcttgtgggattggtaacattcacggcatttaccctgctaactggccagggttagactttgaccgccttcaagaaattgcgaatgcgattgatattccgctagtgcttcacggtggttcaggaattcctagagaacaggttcaaaaagcaatttcaatggggattgcaaaggtgaatatcaatactgaattccagttagcgttccaagatgcaacccggaagtatattgaaaatgaattagacctcaataaagaacaaaaaggatatgatccgcggaaattattacttcccggaacagatgcaataactgctaaaatgaaagatatgattgaatggttaggcacgccagcagtcgcctaattataatggaggttatcgaatggcaatcacagtttactttgtccggcacggtgagacctacttcaaccggtttgctcgcctgcaaggatggtcagataccccgcttacagaaaaaggagagatggatgctaaaaagatcggccaagttttagcggacttaaggatcgattaccttttctccagtgatttaaaacgagcagttgatactgcacggcttttaattgcggatcacctaactgcgacggtgaaggaaccaatccaaaaaaagttcttccgcgaggtattttatgggtcttttgaaggtcatagtaatgaagaaggcgctatctgggcaagctatcttgaaggcaagcgatttaggcgtatcggtgaattagttgatgagtttggcgttgaaaaagcgcatgacttactgaaagccgccgatccggctcaccttgcagaagatagtaatgaattaaatgcccgtgtagagcaggcaattgcctttttgcaaagcttaccggatgagagtaatgtggttgtagtagcccatggatcgattatccaatatattgcggggatgtatgggaaacctggatacaagtatgaaaacttacataacggcgcgctgatgaaggttcagctaacagctagagacgttgaaattactggatacaatcaatttaaactataaaaagaggcaaggaattattttccaaacctcttttgttgttaggacaattctttagtaattttatccagccataatggcaatgtctcgtttaggctattgtaagtatcttcaaagcggtgagtataccaaggatcaggaatttcttgatcttctttgccaggaattacttcatatgctaagtggactttatcacgatcttgcgctggtgcaatgcgttgtaagttgtacttgttcatattatccatgcagatgatgtaatcagcccactcgaagtcttgtcgtgtaattgggcgtgagattaagccatccgttgataacccgtgtgcgtgcattgtctttgcggcacctgggtggggaccatttccttcttcttcgttacttgttccagcagaatcaacattgattttgccatttaatcctgcgtcatcaaccatttgcttgaacattgcctcggccattggtgaccgacaaatgtttcctaagcagacaaataaaacgttcatgtaatcacctcgtttatacttctatcataccgaaaaagataatattttgctaaaatattcgggaatcctaacactatccttaagtttttggtaaaattaagaacaaatatttttagaggaggaacaaaaatgacccttattattgtaattgttgtcattgtcttgttgattgctatttatgcaggactttacaacagtttgattcaattgcggacacacgcacaagaatcctggagtcaaattgatgttcaattacaacgacgtaacgacttgatccctaacttaatttcaacagttaagggctatagcaagtatgaagcgggaaccttggaaaaggtgacaaagctgcggacggaattaaatagtattccagacagcgatcatgctaaaaaaatggaagtttccaatgaattaacgggaactttacggacattgtttgccgtcgctgaaaattatccagacttaaaagcaagtgctgaataccaaaaattaatggaagaattaaccaatactgaaaacaagattgcctactcacggcagctttacaacagtactgtggcggctttagatgctaagattcaatctttcccaagcaatattgtggctaaaattcatcacttccaacaaatggattacttacaagtgccagaagaagccaaggctgtgccaaaagtttcatttgatgatttaggtgattaagcatgttatatcagcaaattgcccgtaataaacgaaaaacaattttggtgatgtttgggttctttgtattgcttgctttaattggggccgcgattggctatttatttgcgcggacagtgattggcggcatgatcattgcggcgattattgcggtgatctatatgtccgtgatcattggtcaatcgactgatgtagtgatgcggatgaataacgcgacggaggtacgatcagcgagtgatgcgccagaactttggcatattgttgaagatatggctttagttgcacgggtaccaatgccgaaagtctatatcatccatgacccaagtcccaatgcttttgcgactggtaatgatcctgagcatgctgctgtggccgctactactggtttgatggaaaaaatgaatcgtgaggaactagaaggggtaatggcccatgaaatgactcacgttcgtaactatgacatccgtctgcaaacaattgcgttagccttagcatccgcaatcgcaatgcttgttaattttgctggaaatttctggtggattggtggtcggagcagtagtgatgaccgggataatccatcaagtattttcgccatccttggttcgattcttttgattatcttagcgccattggcagcaaccattgcgcagatggctctttcacgtaatcgggaatacttagccgatgcaggtgctgtggaattaacccgtaatccgcaagggatgattagtgcattggaaaagctaaaaactgctgttccaatgaaacatgtggacccaagcagttcggcattatatattagcgatccagaaaagaacgctaagcaccatcctttttcaaatctatttgacactcaccccccgctagataagcgaattgaacggttgcgtcaaatgtaataagtttatagcaaagactgagaaaaaacttttgctttttctcagtctttgctatttttactcacgacttattgtttttaatcgccttatactagtgagggtgatataattaaaaagctagaccaaagtatcaaaagaagaggtatctttttcatgaaaatgaaattagcggaaattgccaaggcgatcaacgcacaaaatgacattgaacaatggaaagacgtagaagtgactagtgtgtcatttgacagtcgacacttagatcaagggagcttatttgttccattgcaaggtgcccaagacggccaccaatacgtaccgagtgcttttaccaatggtgcagtagctagtttatgggctagtgaccatgagataacggatcagacgcacccgctattagtcgttagtgatccactagcggcccttcaacaactagggaagtactacttgcataagatcaatccgattgttgttgcagttacaggcagtaatgggaagacgacgactaaagatatgattgcgtcaatcttaagtacgcagtttaatgtcgcgaagacatatgctaattttaataatgagattggggttccagtaacgcttcttaacatggagtctaataccgaagcagtggtagttgagatgggcatggaccgttttggtcagcttgacttcttaagtaagcttgtaaatcctgacattgccgttattacaatgattggggaagcacatatcgaattcttcgggactcgtgataagattgctgatgcaaagatggaaattacccatggcctaaaggaagatggaacactagtatttaatggggatgaaccattattagaggaacgggtaaaagatcttgcccaacgacagatgcgctttggtcggcaactaagcaataatttgtatgcaacaagtgtccacgatgaaccacggcagttatcatttaccgtcaacgaatggccagatgaagaattcactatcccaatggttggtgaatacaatattaataatgcgttagcggctatggaagtgggtaagattctgcatattactcccgcccacatgaagcaagcgttggcaaacgttgaattaacggaaaatcgtgctgaatgggttaaaggaaagaatggtgaacagatcttaagtgatgtttacaattcaaacccgaccgctgccaaggaagtccttaagacgattgcagaaacaccagtagctggtcgccggatcgccgtattaggggacatgctggaattaggggatgctgcggcaaagttgcatgctagcttagcagaagagattgaccaccaaaagattgctagtgtttaccttgtaggcgaacaaatgaaaaatcttaaagataagttgatccaagaagggtacccagctgaagatatccatcattatgctgctagtgaccttcaacaattaattgccgatcttacggctactttgacaggtgaggatattgttctattgaaagcaagtcatggcattcacctagaagaagtcttgacggcattaaaagcagaatagttaatatatttgccagtcgattactgatgcttatatcataaatcgactggtcatttttaggaggaaaatttttgaagtttagtgaattaggcttatccgatagcctattaaaagcaatcaaacggagcggatacgaagaagcaacaccaatccaagaacaaacgattccaatggttcttgaaggtaaggatgttattgggcaagcacaaacagggactggtaagacggctgcttttggattgccaattattgaaaacgttgatactgaaaatctcaatattcaagcaattatcatttcaccaacacgtgaattagcaatccagactcaagaagaactttatcgtcttggtaaagataaacatgttcgcgtgcaagtagtatatggtggggcagatattcggcgccaaattaagagcttgaaacaacacccacaaattctcgtggggacccctggacggttacgtgaccatattaaccgtcatacagttaaacttgaccacattaagacccttgtcctcgatgaagcagatgaaatgctaaacatgggattcttagaggatattgaatcaatcatcaaggaaacaccagatgatcggcaaacattgctcttctcagcaaccatgccaccagaaatcaagcggattggagttcaatttatgtctgatccggaaactgtgcggatcaaggccaaagaattgactactgacttagttgatcagtactatattcgcgcgcgtgactatgaaaagtttgacatcatgacccgtttaattgacgttcaagatcctgacttaacaattgtctttggtcggacaaagcggcgggtagatgaattgtcgaagggcttgattgcgcgtggctacaatgcagctggtattcatggtgaccttactcaagataagcgttctaagatcatgtggaagtttaagaacaatgaacttgatatcttagttgcaacagatgtggctgctcggggcttagacatttccggggttacgcatgtttataattatgatattccatctgacccagacagctatgttcaccggattggccgaacaggacgggccggacatcacggggtatccttaacctttgttaccccaaatgagatggattaccttcatgagattgaaaaattaacccgggtacggatgctgccacttaagccaccaacagctgaagaagcatttaagggtcaagttgcctcagcctttaatgatatcgatgaattaatcgcgcaggattcaactgatcgttatgaagaagccgctgaaaagctactagaaactcataatgcaactgatctggtagcagcattgttaaataacatgacgaaggaagcggccagtgaagttccagttaagattactcctgaacgtcctctcccacggcgtaacaagcggaataaccgtaatggcaaccgaaataattcgcatggtggcaaccactaccggcgtaagaatttccgccgtcaccaacatggtggtggtcaccgaaatgataaccatggaaagagccattccagtcgccatgcatttaatatccgtcatcgaaaagaagattaattagctaagaagtctttggttgagatttgaccaaggactttttttaatttggcagattgcaagaaataatttgaacaaagttagtgacgcagattacgcaaaaagatctcaatcggttgacctttggggataaagcgtcgtagtactcggttgcgattctcattactgccccgttcatgtggagaataagcatgcgcaaagtagaggggaatcctggcctgctcttcaattagcttgtagttagcgaattctttcccatggtcaacagtaaggatcttgagattatcttctaactggttagctaattctaaaatggccttggtcattgaggtgctatctcgtccctgaagccgtttaacgatgacaagacgactcttacgctcgacaaacgtagctattgcttgacctttacgctttccagataaaactgtatctgcttcaaagtgacctgaggtatgacggtcaataacttcagcgggacgatcttcaatggaacgtccatggctaaaagtaccacgggtttctttggctcgtcggcggcgaattccatggtcaggtaaatcagccacgccaatatccaatactccttgatcaatccaggtgtagatggtcttgtaggcgattctaactacatgagccacttgttcaatcgaccatttttggatcttaatcttttcttcaattaatcgcttgaggttactcgttaagatggttttacgcccacgatgactaagtttagcttcatgatcagcttgagctttaactgtgtgatattcatcagtcaaacgatgaacctcattaaagatcgtggttttactgaagccaaggtaatcagcgatgtatttaagggagcggctttcataacgaagagtttcgatgacaacacggtcttcaaatgataaaatagtggtgcccataaaggtccttctttctaatggaatgttgtggtgacaccattaaagacctttatgggtttttatgtccactaatatgttcaacttaaattttgcaatctaccataaattaaatatgggtttgtgacttaagttaagttacttccataaaagacaaatggcgcagtacaacaatggcctccaacgcccggtaaaaccgaacgttggaggcctactgttgcttgcgggggctcgaaaacgaagtcacgagtgacttctgtctcgctcccatttcgttatctttttttataaaaatatttattctaattatttgatttatttataatatatttgttgcgactattacgatgattagtatctgagaagatgagctcatgtagatattaggctattatttcatcatgcaaattaagtgtaaaggggggctaatttttcttgtttggtacttgaggagctgcagggttatttatgccttgtgtgagagaggttttgacgatgcaaaaattagagcaattgattgataaaaactttgctgaaacagctcatggtaaggttgcaaactatattccgatattaggaattgttgatccgcaacaactgggcattgccatttatgacgttgacgaggacgaaattgggaccgctggaatggcaggaacgcgatttgcgatcgagagtattgcgaaggtcataactttaatattaacgatcaagagattaggacataagcgcgtcttagcagaactagaaaatggttcggcagattatagcctaagttcggtactattggatgacgagttaaccgagcaggtccaccgggtaaattaccttaataattcctccgctttgttaacgacagccttaattgaccagttgatggggcagaatagttttaatgcccttctcggtttctgccgtgagatctgcaatgacccatgcattagcttgaatgagcgtttatttcggtcagcaattatgaatgataaagatattcatgcactggcttactatatgaaagataaagatattttagagactgttgatcaaacattgataacttattttatgcaaagctcaatgatggtgacatcacagagtcttgctaacctaggagcagtcttggcaaatgatggaattaaaccttgggataatgagcgtcttattagccatgaagataacgagttggtaaagaaattgctaacaacagttggttcgtttgaagaatcaaaagaatacacaattaaaattgaactccctattaaaagtggtactggcggcggcttattggcttgtgccccgcaaaaatgtggtattggtatttttagtccagctcttgatcaacatggcaatagtttggcaggaatgagtttattacaagatgttgttgatcaattagaattagtagtttaatcataaccacccgtcaaacgggtggtttgcacatcggctataagccgataataaaagccggcgtctcaaggcgctggctttcgctttgctcaagccaaaatgctctgactactttgccaccgctttaagcggtgtttatactacctcacttacccttaaaagggtccgaatattccacacttgttagcttatccattgctatatcatgtttctcttgatctcggatatacttctttatcgtggattcatttaatccaactgtactcacatagtagccttcagcccaaaaatgtcggttcccatatttgtattttaagtttgcatgtcgatcaaacatcattaatgcacttttcccttttaagtatcccataaactgcgagacacttagtttcggcggaatacttactaacaagtgcacatgatctggcatcatatgaccttcaattatttctactcccttatatttgcacaacaaacgaatataatctctcaggtctcttcggtattgattgaagatcgctttacgtctatactttggtatgaatacgatgtgatacttacataaccacttcgtatgggctaagctatttaatttattagccatatttatataacctcttttcccttattgactttggcttgaacacctacatcttaaggcaaaagaggccttttttatataatttttatcgcccacccgcatagcaggtggttttttgtttcgtgcactcgctctgctcgcgcactcaactaggtctaaagacattaataaaagcgaggcccgaagaaaaaaattcttcaagtctcgctttttgtgtgcgcccggcatgggtattagctaggcggtgagagtccgctatgggccgtagtagtcggaaccatgagctgaggacaagggtgtccactgtgaggtggaatctgaaggaagtctaaggcaaagtactgcaccgatgaacaagaagtagctataaggctggaactaactggataagactgcacgacaagttaaagtccaacactactcgaagttactttcagtaaagctaccggtgacatggtgcgaaagttaatatccttacccagggagatctggcctacacgtttccgacaagaggaataagtttaatttccacagaaacaagcggtgcagtgatgtagcgttgagtaagccagaagtcagctgaggtcatagtagtctgagtaatcagatgaaggactgaacgacaataacttgtaacttatatcggaggtgtaatcaggtgcgacaatcgcagaaaacagaacaacaagctgaccgcttgtcgaggataggtttggaaaaccgaaagtacacaagggcgcgtagtaccgattatggtgaaggtaaaggtatgagtgtcactatccaagacttagtcttggaccgcaataaccttaatcaggcttatttgcgagttaagagaaataaaggggcagcaggcattgacgatatgacagtcaatgatcttctgccatatctcagagaaaataagacggaattgatcgctagtttgcgtgaaggcaagtataaaccagcaccagtcaaacgggtagaaattccgaagcctaatggtggagtaagaaaactcggaataccaacagtggtggaccgaatggttcaacaagctgtagcccaaattcttacgcctatctttgagcgtgttttttctgataatagttttggctttcgtccccaccgtggggcccatgacgctattgaaaaagtagtagatctttataatcaaggttatcgaagagttgttgacttagacctaaaagcctattttgataacgttaatcatgacttgatgattaagtatctccaacaatatattgatgacacatggacactaagactcattcgtaagtttctaactagcggagtcttagatcatgggcttttcgctaagagtgaaaaaggaaccccacaaggagggccattgtccccactactggcgaacatctatctaaatgagttggacaaagagttgactggacgtggtcatcactttgtgcgctatgcggatgattgtaacatctatgttaaaagtcaacgagccggagaacgagtaatgcgaagcattacccagtttcttgaaaagcgcttgaaagttaaagtgaacccagataaaaccaaagtcggtagcccgctacggttaaagtttcttggctttttgttgggtgtagaccacaatggagcctacgcccgtccagcaaaacaatcgcaacaacgagtaaagaaagcattgaggttattaactaaacgtaatcgtggaatatccctgacaagaatgtttgaagaaattcagcgaaaaatgcgtggatggcttcagtactactcaattgggaaactaactgactttattcaacgccttgacaagtggttgagggcccgaataagacagtatatctggaagcaatggaagaagcttaaaactaaggtaactaacttacagaagctggggctgtcccagcgtgatgcatatggcttcgctagtacctgcaagggctactggcgaactgcacacagtaagaccttgagctattctctaactaatagaaaactggaacaactcggacttatgaatatgtccaagacgctccagtcaattcaaagtgattaagttgtcgaaccgccgtatacggaaccgtacgtacggtggtgtgagaggtcgataattgaactaatcaattatctcctactcgattaatgtaatttttcttggaatttctgtaaattaccaggagttggggttaagttagtccattctggtgaaaggaacttactattgatttgataatgtggttgcggttgcttgttagaaataaaactattagtagctttatcaacttttacccaaccagcccaaccgatatgaatagtatcttccataaatccaggcttatcaccatcatgagaaagatccaaaatgtgattgaacccttgttggcgaagctggaatttgattttttcaacagattggtaatacatattcatgtccattcccgtgtacttttcccactttgaattaaccggtgggatgataaagaggacgtttgaattggtattcttaaactgattcaaaactacttccaaatcgccatattctggtgacttagtataattgaaattccgttgtgatccctttgttttcgctaagtttttcttcacacgctgggtatagaagctgtttttgataccgaaacggttgttattagtatcacgtgcggcttcattcattgcatcatcataaagttcattatagttgtaatgctgaggaagcttcttaacatttgggaggatatgcttgccatagttattatttaattgaaaacctgagaagatggcatcttcatgaacaagcatgttaagtcggaagcggataactcccatgtcgaaactgctcagggattttccttcagcgatttttttagcatacgaagaaacagtcccatctttgccaagcattgcaattaatcgcgttgcaatgtaacgatcatatggtgatttgggattagcgtgttgaagccagttaaggttagcgagttcaccattatagtacttgaaagctggtggttgaacaccctgcttggtaaaccattgtggtgaaatgatatagactgccttattatttctcatctgcgtttccattgaattaatgttaaagaattgcggaagagattgggtaccccgtgaaccaaagaggaaaggagtatagttatgataacgagcagccattacagaaggatggaagcgatccattcgccgtaattcactagaaccaaagaatggaacatagtgggtgtgcttatcactgagcgcttgttgcttaattgattggttcttaaaaacaacggggcttagtgatactgcagcttcatgttcaatcgccgctgagtgctttttactaatcggcagtgaaaacaaaagaactactaatagacaagcgacaatcagcgggccaaagattgaccacagctttttgccattatgcattttggagctcctttacccgttcttcaatcttttcaatagtgtcccattggttacggtcaaattctgaaactggtacttgaacgccaaaagcatcttgtaaaccgagaagaagactaacagttgccattgagtctaaaagaccactttcaaaaaggttttgacttgcatcactaaagtctgcagtatcccgaccagttgcatcagctaaaatattaataatttgttcttgcataattaaaatcctcctaaaattatttgaatagataagtatctaagaacccactgaagatcaagaaagtaaacattacaaagttaaatgtgacaaaaatagcaactccagtagtgaacttattatgtggtagctgttttaagtttttgcgcttgaaacgcagccaccagtcattaactactaggcctagaccttggagaaaaccatagagaatatagtaccaggtaattccatgccaaaagcccattagtaacatattaagcatatatgcggttgatgacaaggtatttcgattcttaaaccatcgttttttggtagcaagaaagacgaaccgcataaaaatataatcacggaaccagaacgaaaggctgatgtgccaacgattccagaattctttaaggtttttcgatttgaaaggctgcttaaagttcattggggtccgcacacccataaagtaactaatagcaactgcaaacaatgaataaccagcaaaatcaaagaataagtaaagtccgtaagtgtacatgacaccgactaagttccaagaagggaatgatggatcagctaaggccgctttttcaaagaaggggtaaaaacgctgaccgaagaaataaccgatgacaaatttgtacaagaaaccaaggaataagtagagaattccggtgttaacaagattcaaatattcctcgcgggtcgggacctttttataatccttttcaaaacgccggtaacgatcaattggtccagaagtaatggttggcatgaatagaatgaaacgaatgaacttccatggggaaatctctttgatcattccatcacgcgtttcaattactgttccgactgcccggaaagttaaataactaattcctaagaaaccaaggagggagttatgaccaaccattgccggtgaaagcttaacaattacaatcggcaaaattgataaggcggcagtgaagtaaaaaacaccactcgaattattattttgccggtagcgatgataagccatcacaataattgtctggtaaataacataagcaattaatgaaattccttgttgccagcttgaaccatcgaacattaagaagataaaaatgaaactaattaatgcttcataccagctaaacctcttcccaaagtaaaggccgattcccaacggcaaaatagcaagaagtaagtagaagaagtataccggggttccataagcactgaaattaggaaggtttgaaatccaatcaatcattacttgttagcctcagcaaccatttgtttaactgcaatcttgccatttgcagacattgggaatgattcacggtaaacgaattgggtaggcatcatatatggcatgattaagccgtccaagctttcacgaatctgttttgttaatccagccgtatctccagtcgcttcgtttggaataacataagcaatcaggtgcgtaactttgccatctttattatatttcggaaccgcaactgcttgtttgattaaagaactcttttcaagactggcacgaacttcatcaagttcaatccggtaaccatgtaatttaatttggaaatccatgcggcctttgtggtgaagtaagccatcgctgtcaagagttcccgcatccccagttcggtaagcaggcacaccatcaatcttaaagaatgacttggctgttttttctggattattcatgtagccacgtgccacactattaccactaattacaatttcaccttgttcaccaggagtagtgatttcttgattgccattccaaatggataatttgactcctggcttagcatagccaactggtaggcgatcattattttcaatgatttctggtgtgatttcgattcctgatacggcaactgttgtttcagttggaccgtaagtgttgaagattttagcatctgggaatcgctgatgtaatccttttgcagtctttactgttaattcttcaccacagaagagaaaggtctttaagcttggcattttttgttggttaaatgctgggctaagcattaacatatcagcaaatgatggcgtccctacaaaaacttcaagatcaaggtttggtagagcagtaaacatctgaccaaaattctcaacaacttcgtgaggaagcgccttgattgtcccaccattaagtagtgctggtaaccagtacatgtttgaaagatcaaatgaatatggtggttgccctaagaaattagcatgttctttgatcttaaattcatcgcttaacatccagtcaacaaaggtcataaagttatcgtgactaacttcaaccccctttggcgaaccagtagttccagacgtaaagaggacataagctagttcgtcaccattaatcattgctgaagtatcaaaagtttgtggtgttgccaaaattttttcaagctgttgatgatcgacaattggggcatcaaactggagatcattgcttggaaaatcattaacagcaataatcatcgccggtttagcagtatccagaattgattgcatccgtggaattgctgaatcgttggacactggaatataagtatgtccagcttttaaagctgctaaaaagctaataatcatttcaacttgatgatcaccatatacgagaatcggactacgatcaggcaaagattgagtactaagccatgccgctaaagtatcaactgctgagcttaagtccgcataagtggtcgttttgcccatttcatcatatgcgatccgcgttgagttgtccttggcaatttgctcaaagacagtaataatattcttactcatatattatctatttcctccgcattagaattcgttgtagataaatggctcttggcctgctccgtaataaccataaaggtagattaataaaagaagcactacaaagtaaaataatgtttttaagatgaatcgtaatgcaggatggcgttgaataatctgagccatagttctccttctctcatctttataaatttgtaattggcattcatatcaagaataccattaattatgtatctcggctaatagggtgagttactttcaccttactataaaatccttaagaaaaaattaatgaaatattcaaaaacaagaatgcttattgccttaaaattataactttttctgagctaattgtaactagaaaaacctaaactttatttataattttatatgacatgacaatgatggactaatgtaacaataattgcaagaagcgcttattttcgataagattaagcggtagatactagtgaggattaaggagacgaacgctcgatgattaaggggattggaatcgatataaccgagattgaacgagttaagaaagccgcaacagcgcattctcaattcatccagcatgtattgacaccgactgaactagaacaatatagtcaatttagcggtcagcgatcagtagaatatcttgctggtcggtggtcgctaaaagaatcttttgctaaagcatacggaacgggaattggtgctaacctaggctttcatgatattgaaatcattgataaccaatatggagcgccaattgtgactaaatcgccgtataatggtaatgctcatgcttcagtgagtcatactgccaccttagtaatgacagaagtaattttagaaagtgagaataaataatggttaatggtcgtttgcgagatacatcattaatagtggacttagatgcattacgtcataatattcaagaacagaaaaaagtattgcccgaaaatagtaaaatcctggccgttgtaaaagcgaatgcttatggcaatggattgattccagttgcccaaacggcaatgaccagtggtgcgagcggtttatgcgtggcaatcttagatgaagcattagaattacgggataacgggattgaagcgatgacgcttgtccttggaattacgtccgttgaagatgcgttgattgctgctcaagccggagtttctttaacagttggctccttagattggcttgaacaatatcatcaactagcacaagttgccaagcctaagaaaccattaaaggttcatctggggattgattcaggaatgggccggattgggtttacagaggtagctgcatttaagcaagctgttaagctgcttgatagtcctgaatttgaattcgaaggaatgttcacccattttgcaactgctgatagtcctgatgaaaattactttaatcagcaggtccaacgttggcatcaatttgttgccagccttgctgaactgccaccgtatgttcatatggcaaattcagcgaccggtttatggcatcgggagacaatcactgctaatacaattcgaatggggatttcaatgtatggacaaaacccatctggacgtgacttgaaattaacgcttgatttacagcccgttagttcattagtttcatcaatttcttttgttaagcagttaaaggcaggaagatctgtcagctatggcgccacttatacggcggagcaagatgaatggctagccaccttgccaattggttatgctgacggttatccacggtgtatgactggttataaagtattagttgacggtcaattttgtgatattgccggacgagtatgtatggatcaaatgatgattcgacttcctaagtattacccagtcggcactccagtagtattgatgggcaagtccggtgatcaagaaattacagcaactgatttagctgagcgggccggtactattaactatgaaatcctaactaatattagtaatcgggttcatcgcatttatcgccaaagtaaataattaagggaagcgaaggtaatgacaaaacgaaaagtaaaacggggtgacatctattacgctgacttatccccggtaattggatcggaacagggtggcgttcgtccagtcctgatccttcaaaatgacgtgggaaatcattatagtccaacagtaatcattgctgcgattactgcccaaatgcaaaaaaagaagatgcctactcatgtccaactaaaaggtaagtcgttaccgttaactcatgattcggtcattttgttggagcaattacgaacgattgataaacaacgattgaaagaccgaattgctcatttatcgccagagacaatggcaaaagtggataaagcattaaccattagtgtggggttaaatgctgcctatgatgaaaataaatgagtttgacaatttgcgtcagaactcgtatactcactattaaattaatcacggttcttttaatgtagcccagagagactacaaaagacaaaataatataagcatagtgggcacaaaactatgcttcctcttttgtaaagctctaggaccattaaagggactagagcttttttaggtctaaggaggatatcttgtgaaagaacaaaaggggacaacaatttttagtattccaatgaagaacagaaagactaatacttgggatatgtttgccacgtgggtcggggcaaatgctaataatgggacatggtttgtcggcggagtgctcgccgcttgtggattttcggttgccatgaaggtcttagtattgtcatctgccttatcatatgtatttttaagtttggtaggttacattggttataagactggggtatcgacgatgactttaagccgtgcctcatttggtgaacggggcagttatctcccatcattagttaatattacccaatttattggttggacagcggttaatacttttattgcggcccaatcggtaagcattcttttccatgacttactaggatggcctgtgtggggacagcatggcggctatttagggctagtagtcgggattattatcatgagtattctccatatcattagtgtttctagcggatcacgttcagtccaaatgattgaacgcttagggataatccttgttcttgtattcgtcatttgggagtcagtggctgtttttcgaactgtttcctttagtcaaattgtaaattggcatgttcctgcgcaatcaaaaatggcagtcggtgcggcggtcgattatgtagcagcttttaatttagcttgggtaactgccggcgctgatttcacccgctttactgctaaagaaaagaacgcaactttgacgccatttcttggggctttactaggggttgtatggtttgcttttatcggcttgatttcaacaattagtattgcgatttcaagtggggtatataacgcaaataactctgatccgtcaacgattgctagtaagttaggactgggggtagttgcccttcttgttattattttgacctcgatgacggccaatgctgttaacttattagcggccggatcagctctttcaaatatctttataaagctcaaattaaagtattcattatggatcgtagtattgcttgcgacagttgtgacctttattccgatgtttgtcggtagtttcttgagtgcttttgaatcgttccttgactatgtggggatggtgttaggcccgacgattgctattatttgtactgatttttatttccgtgctcaccggcaatatgatgttgatgaattaggtaaagttggtggaaaatattggtatcgcggaggcgtcaactgggtagcaattattgtttttgctatcggggttgccttcttcttaggggttcatcagttgccaatctttgtaaatacgattggggccacatttattgatatgtgtttgagtggtattctatattatggaattatgttgctggttgaccgaaaggaagatgaattatgctattaaaaaatgtccatgttgataatcatgaagaagtagtcgatgttcgaattctcaatggaaaatttagtgagattaaggctaacttagcgccccatgatggtgaagaggttattgacggtaaagaaaatttacttttgccaccatttgttgattctcatgttcacttagatgctacgcttactgctggtcagccagaatggaatgaaaccgggactttatttgatggtatccggatttggagtgaacggaaacaagatttaactaaggaagatgttaaatcgcgtgcgaaaaagacattactaaatatggttgggcatggaattcaacacgtacggagccatgttgatgtgactgatcctcatttgattgctgcccgtgctctcctcgaattgcgtgaagaattaaaagaccaaatcgacttgcagttggttgcttttccacaagaaggcattcttagctatcctcatggacgtgaattaatggagcaggcggtcaaagaaggattagatgtcgttggtggtattccccattttgagtttacaactgaatatgggtggcaatctgttcatttcttaatggccctcgcagataagtacgatcgtttagttgacgtccactgtgatgaaatcgatgacccagcttcgcgtaaccttgaagttttagcgaccgaagcttatgaacgagggatgaaggaccgggtcacggcaagtcatacgacagcgatgggctcatataatgatgcttatacttataaattattccgtctattaaagatgagtgatattaattttgtatctaatccattagttaatgttcaccttggcggccgtttcgatacttacccaaagcgtcgcggcgttactcggattaaggaattaacaggagctgggattaatgtttcctttggggaagatgatatccaagatccgtggaatcctctcggcgatggtaacatgttagatgcagttacgatgggtgtttatattgctcacttgatggggtatcaccaactgcaagatgcctttaattacgtaacctataacggtgctaagacattgcatattagtgataattatggaattgaagtaggaaaaccggcaaactgtatcttattgaatgcccacgatttctataatgctcttaataagcatgttgaagttctttataatattcgtcatgggaaagtccttgccgagacgaaaccagctgaaaccaaagttaatatcaaataaaattaaaaaaaactcataatagttattgacaagttagggaatgaccggtatattatatccaacaattaaatttagattagaaaaacattgaaggaaataacgatttgaaattggtgacagagaattagcgggtggtgtgagctgatcgagatttctaattgttaatcgttcctgagttaccggctgaaaccaagtaagctgaggttggctgccatccattattttggccacaaatgattgtttgtgaatgagaggattgactacgagttgatcaaagtaggatggtaccgcgcagaagcgttcttacaattgcgatgaagcaatgtaaggacgcttttttctttctaaattttaagaaaatattttgtcttggaggtaattattatgactgaattaaacgcacgacaggaagaatttgctaaggctctttttgaagcttatgacactaatacgccattaaacgaggaagaatggaaagatgttgttactgatgatgaaaccgcatatgcagttcaagatgcggtagtaaagttaaaaggaaagccaactgcaggctataaagtttcgttaactagtaaagaaactcaagacatgtttgatgctgattcaccattgtacggacaacaagttgctgaacgattcctccagtcaccagcggatgttgacttgcagatgttaaatgaaccgttattagaggttgaattaaccttccgtgcaaaagaagacttgcagcctagtgatacattagaagatttatttcataaggtaactgttgcgggtgccttagaattgcctgatgcacgttttgtcgactggtttccagatttaggaaaatataatgtaatggctgattgtgctgttggtggtcttgttgtatatggtgaagaacatgatgcagatagtgtatttgaaaacgttgacgatgctgctaatgttcatgctgttttattcaaagatggtgagaaattaaaagaaggggtatcatcagaagttttgggcaatccctttaagtctcttcaatggttagtgcaaaaattagctgaacaaggaaaagcatttaccaagggccaaatggtatcatccggaacatttgtcttaccacctaagctcactgctggtaagtgggaagttgagtttgatagcggtttaggaaacgttgtagttaatgcgaaataagtgttgaaagcaggtgggaaaattgggtgaggaatcgccagcggaaattaatattttgagaattaaaaagcgatctgtggttgagttaatcacaggtcgctttaatatttaatagctttggtgcaagtcttcaatttctgaaacttccaacccttttttctcaagtcgtttaacaattcgttccatcttttctttagtaacatcagcaggcaaggtgtataagactcgtttcattgtctcgtctttgggatcgagtgaaatgacatttacgatctgacaaaaacgagtgatttctttggcagccgttaccagcgctccccgttcatcaggagtaataacagttaaaacataactcccattattcacgttccagccagcagctaacatccgtaaaagactattatgggttaaaatcccataaaactgattattgttatccaataccgcaatatatggaaggtctcgaatagcaaagaagatagagaagaaagccgcgttaattgagataaatttagtagcattctttaataatgcagttaccggtaaatgcatatccccctgtcgtgctttatgccggtaaagatgcatcttataaatatttccccgaaagatctttcctgacttatcaagaactgggacacaccgatagccggtatcctccaagacagtcagagcctcatccaatgtcgctgtttctggaagagttgttaaggttgctttgggtttgattaatgaattgaaaatcataattaacatcctttttatcgattaaatgcactcactataataacacatttctatcaaaaggattagaaaaagattagaagatttatgctgttaattcaaattagtatgctgaaaaaagtaacatagggtataatactagttaaaatttatgctggacgggaaaagtgaccgtgcggcttttttgcgtgaaaggaatgaaagaataatgaaaatgattgttggcttaggaaacattgggacgcggtatgatgaaacccgtcataatactggctttatggtggttgatcaactagcacgagattatcatctaggagcattcacccacctaaaacaagaagcagtcgcagtcagtggggtaattaatggtgaaaaagtaatgttggtcaagccgacgacgttcatgaatgattcaggacgagcagtcggaccattagtagactattatgatattgacttggatgatctcgtaattgttaatgacgacttggatatgccagttggcaaagtacgtttaaaaacacatggggcttcaggcggtcataatggacttaaaagcattatcagcgtgttaggaaccaagaactttaatcgggtaaaagtagggattgaccatccccaacatggaacagtggttagtcatgtcttaggtaaattttctaaagaagaacgtcctaaatttgaccaagcagttgaacaagctgagcatgcattagaagactggattaatggagaagactttgccaagttaatgaatgcttataattaaaatagaaaggtggcgttgatggtgcaaatagaaaatttaatcgagaagacgccatcatttaaacaaattacggctgacctccaacccaagaaccatcaattgataacgggaatttctggatcagcgcgaactgaattgctaagtgctctttctaaagaagggcagcgaccaattttagtagtgaccgacacaatttcccatatgcaggaattagctagtgatttagagaaccttcttcctgccaatcgtgtttatcagtttccggttgaagaggttttagcagcggaagtagcaactagttctcctaactatcgtcttcaacgggtactggccttaaatgcgttgattaataacgaaccggcagttgtagttgcgtctgctgcggggttacggcgcaatattatttcaccagaatactttgctcagtcctcgttaaagattaagactggcggggaagtggatccagtaaaaattcggcaacaattaagcgcaatggggtaccaatatcaaaaaatggtcttgcgtcctggtgattttgcgattcgtggatcgattattgatatctatgccttaaatactgataatccggttagaattgatctttttgatacagaagttgattcacttcggtattttgatgctagtacccaacggagtattgataatgttgaagaagttcagatactgccagcgacagactttattatcccagcgacagaattttcgcgggtgtatgaagcccttgatactgaatacaaaaaggtagtgaaggagttaagtgctgacgatgctgatattaaacagcaggtggctaaccgctttgaaccattattgaacgcgcttaagaaccagcatttgcctaatgaacttttagaatttagcaacctagtttatccgacaaagcattccttatttgattatcttcctgatgatgggacaatttactttgatgacttgacgcggataaagcaatttgccaagcagatgacccaggaagatgcaggctggtttaaagataaggttgctcaccatcaattaacggatgttccagatcttagcaatgacgtatcgaccataataaaaaaagacctgcatccgcaaatttatggcgccctatttaaaaaaggtctcggtaatattaaacttagccaaattactgacctaaaaagcagaaccatgcaacgtttctttgggcaaatgccactactgaaagctgaacttcaacggtggattgatcaagggcaaacggtaatcctgatggctaatagtccagaacgacgaaagcaaattgcccaaacgcttgctgactttgatatcaccgcaacagaaactgaattaacaaatatcaagccgaatgttgtgcaaattgttgctgctaacttaaacaatgggtttgaaatgccgcttgctgggctggtggttattacagaaagcgagatgtttaagcaggtaaaaagggttcatcatcgtccacaaaaacttgccaatgccgaacggttaaaaaattatactgaccttaaaccgggtgactatgtagttcatgtcaatcatggaattgggatttttagtggaattaagacgatggaagttgaccatgttcaccaagactacatgatcatcaattaccgagataacgctcagatatatgttccagtaacccagctaaaccttgtccaaaagtatgtatcatcagaatctaagaccccgcatatcaacaagcttggcggtaacgaatgggcaaagactaagcgacgcgtttcttcaaaaattgaagatatcgctgatgaattagttgacttatatgctaagcgagaagcggagaaggggtatgcttttccgaaagacgattatctccaaaaacaatttgatgctaatttcccatataatgagactcgtgatcagttgcggagtattgatgaaattaaagaggatatggaaaagccaaagccgatggatcgactattggtgggggatgtcggctatggtaaaaccgaagttgcaatgcgggcaatttttaaggcagtcactggaggaaagcaggttgccttccttgtaccaacaactgttcttgcccagcaacattacaacaccctcatgcgccggtttgaaggcttcccaatcaacattgccttaatgtcacgtttcaagacgccgaaagagctaaaagagacagaagcaggattaaaggatggaagcgtcgatgttgttgttgggacccaccgaatcctatcaaaggatgttgagtttaaggatcttgggctgttaattgttgatgaggaacagcgctttggggttaagcacaaggaaaaactaaagcaattaaaaaataatgttgatgttttaaccttaacggcaaccccgatcccccggacattacacatgtcaatgctgggtgtacgagatttatcagtccttgaaacaccgccagctggtcgttacccaatccaaacctatgtaatggagcaaaatagtagtgcgattcgcgatgggattattcgtgaaatgcaacgcggcggacaggtttattaccttcataatcgtgttcatgacattgaagagacagtggcatggttacaagaacttgttcctgaagcccggattggctatattaatggtcagatgagtgaaaatgaactggagacagtcctctatgagtttattcaaggaaattatgatgtattagtgactacctcgattattgaaacgggggttgatatcccgaatgcgaataccctctttgttgaaaatgctgatcggatggggttagcacagctatatcagattcgcggacggattggccgtagtaatcgggtggcttatgcttactttatgtatcagcctaataaggtcctaaccgaattaggagaaaagcggctagctgcaattcgtgattttaccgagttggggtctggatttaagattgcgatgcgggatcttgctattcggggagctggtaaccttttgggaaaacaacaacatgggtttatcgattctgttggttatgacctatattcggcgatgcttagtgatgcggtagctaaaaagcagggtaagaagcaaactattcactccgatgccgaagttgagttaggggttgaagcttacctgccaacggattatattgcagatcaacggcaaaagattgaattatataagacaattcgccaagctaagacggatgaagaaattattgatattcaaggtgacttgattgatcggtttggtgattatccagcaccggttgggacgctgttgcttgtgagccaattgaagaatcatgctgacctggcaatgattgctgaaattaaacggcaacgggataatattaatattaaatttaccgaacgtgctagccgcttaattaaagcccctgcaataattaaggagatagctaatacgcggtttaaagcgacgattggtgaagataatcagcaactaacgattcggctggttattcaacctaaaatgactactgatgattggcttcaccagctactacaatttgtaacggctttaggaaatgttatgcaagccgatgaaaaaggagcggaaaaatgagattagataaatttttaaaagtatcacgaattattaaacgtcgatcaatcgctaaggaaatcgcggatcaaggacggatcttaattaatgggcaaccagcaaaatcatccagtcgggtagcggttggtgatactttaacaattaagtttggtaataagaccgaaacagttaagattaatcggattgttgaaacgacgaaaaagagtgaagcggaagatatgtatgaaattattgatgaaacttacgcggaatcctttgaccaactataatgtcttctgagatataaaaaagttgataatcatatggacattctccgcggtatcttgctatacttaaagcgtgataagttaaaatggaggggaatgtcagatgaaaggacaatctgatagcaaaatttcacaattaaataccccatatgcccgccaagtttcgaatcaaaaaacatataatcggcatgtgcataagcgccgttgtcagcggattattgccgtttttttggttatattcttaatctttggaattcagatatttcagagtaaacggacattagcggatattaatggcaatattcgacacgcacaatcacaattaacaaaacaaaagcaaaagaatcaacaactgcaacgtcaaattaagttgttgcataatcccgaatatattcagcaggttatccgtgccaagtataactactctaagaagggcgagataatctataatttgaactaatgatcacaaaataggatgtttttagtagggttagaatattttaaatgttaaaattaaaaatgtaattgggtgatttttcagcttagttttttatgagaagttattttcatacgttttcaagatgaagttatgatatactcaaatacaaaaatatgagatggttcaggaggatctataggtttcatggcaattgaagttggagcaaaggtttcaggtaaagtttcaggaatcactaattttggtgcattcgttgatttagatgacaatcagacagggctagtacacatcagtcaaatctctgataaatatatcaaggatgttcatgatgtattggctgtcggggatgaagttacagcaaaagtaacacggattggtgatgacggtaagattgctctttcaatcaaggccgcagctcctcgtgaacatcaagatcatcatgaaaataaccatcatcgtgaaaataatcaccgggattttcatcacgaacggaataataatttccgtggtcacaatgacaacttccgtggtggttttagcggtcgccaccataacagtcaccaacacgaagactttaatgacatgttagctggctacctaaaggaaagtgaatcacgtttatctactttgaagcgtcaaactgatggtaagcgtggtggccgtggtggtcgacggagctaatatgacggatttacaacaagcatttgagcgacacctagtaaggagtcgcttttttgctacccaggataaggtagtagttgccgtttcaaccggggtcgattcgatggttctgttagatctcttgcagcacttgtcgtcaaagaatcgtccccagattatcgttgcccatatgaaccatgagttacgaaaacaaagccagcttgaagaacgattcattcggcaatattgtaaacaaaatgatttaaaactagcggttacacactggccacaagatcttcatccacagactgggatcgaaaacgctgctcggcaagcccgctaccaatttttccggaaagtaatgaaagataatcgggcaagcattctgctcacggcacaccaccaaaatgatctagcagaaacaatgctgatgaagatgactcgtggtggtcagttgagtcaattagtgggaatacgggatcggcgcccatttgcttctggaaccttaattcggccactcttaccctttagtaaacagcagctaaagaaatatgctttacagcatcatcttaagtggtatgaggataagacaaataaggacttgaacattcaacggaatcgatttcggcatgcgataattccaatgcttgaagaggaaaatccccagttgctttcccacctcgaaagctatcatcaacagttaacggatctccttacctggcgtgaccaagaagttgcagatcaattagcagcatgttttgatcaacaaggaagaatgatcctggcaagtttagcgaaaaacaaggaaattattcgaaaagaaattttacgacaatggtttaatcaacaaggaatatatgatattaaggaccagcaacttgatgaattgttggaggccttagaaaacgagcaaaagccacagcaaatcattgaattgccgcaccgatatattcttgcgaaatcctacgctacttgtgcgttaaaaaaattggataatccgcttgagaacctacaaaagccccaagatcatgtgataaaattggaacaatggtatcaagtagatccaataaacttaatggcagtgtcagctgaaagatcgtttttcaaggatgaagagcaggtagtttcgcaatggcttgctcctgatcaatttccgctgcggctacggcaatggcgacaaaaagatcgtattcgcttaaaaaatggccatcaccaattagtcaaacgggttctaatcaaccaaaaagtttcccgaaaacagcgtgaccagcaaatggtcctggttgatgcgcatgacgaggtcgtctggatagttaatcaaaagtggagttggtttgaacggccaaccggctatcagctgacatggcagccatgttttattggaataaaaaataaggagaagaaagtaaatgaataacgatattgagcgtgtcttatatagtgaagaaatgcttggcaaacgaatggacgaattagcaacggacttaacaaaagattataaggataaacggccaattatcatttccgttctaagcggggcagttttatttactgttgacatgattgaacggctagatattatggctcaaatcgactttattgatgtttctagttattttggtggattaggttcgactggaaaagttaaacttatccatgatttaaaaatagacgttaaagaccggcatgttctaattatggaagatattgttgatactggtcgtactttgaaatacttgatggacctgttagctgaccggggagcaaagagcatcaaggtttgttcattattaaataagccagaaggtcggaaagtagatatcgaacctgactatgttggctttacagttcctaaagaattcttggttggatatggtctggactacaagggattctaccgaaatttgccatatgtgggaattttgaagccatctgtataccaaaatgactaaaaatgttagataattaggatgacggaaaaatcgatattaaatggacggtattttaaagatattcttaattaacgtccatttttatggatccgtaaatatgtagtatgtattattaataacattggtgataaaactattaattcttctgtgaaattaatggtcaatatttgtcaaatatgctatgatagtgactacaattataaaatatcgttgctggtagataggaggttgttatgaacaacaatcgtaaaaagaataattttactcataacgttctcttctatgccgtgatgttcttgtgtattatgggaatcgcctacttcttctttgggggcaatactcaacaggacaaagcaagaccgtttcccaaagcgagtttatctccgaactgaagagtaataaggttaagagcgttcagcttcagccaaatggtggtgtatataaggttacgggtacttaccgtaaaccccagtcaaataatgacaattccgccaacaatactggctttgctcttacaccacaacgaaacaataaggtaacccaattccaaagttctgttttggaaagtgacgtaactgttagtcaacttcaaaactatgctaaccgtcataatgtaaagattagtactcgtgctgaagaatctaatagcgtctggatgaacctgttgttgactgtcttgccattagtcatcatgattttcttcttctacatgatgatgggccaagctggtcaaggtggcggcggccgtggagtgatgagctttggtaagaccaaggctaagccatctgatgctaagaaaaacaaagttcgtttctcagatgttgccggtgaagaagaagagaaacaagaattggttgaaatcgttgaattcttgaagaatccaaagaaattcactaagcttggtgctcgtattccatctggtgttttactagagggacctccaggtactggtaaaaccttgctagctaaggcagttgccggtgaatcaggggtaccattcttctcaatctctggttctgactttgttgaaatgttcgtcggtgttggtgctagtcgtgttcgtgacttgtttgatcaagccaagaaagctgctccagcaatcatcttcattgatgaaatcgatgccgttggtcggcgccgtggaaatggcatgggtggcggtcacgatgaacgtgaacaaaccttgaaccaattgttagttgaaatggatggtttccaaggcgatgaaggaattatcgtcatggcagctactaaccgttcagatgtcttggatcccgccctcttgcgtccaggacgttttgaccgaaagattttagtcggtcgtccagatgttaagggccgtgaagccattttacgagttcatgctaagaacaagccaatggcaagcgacgttgacttaaaggaaattgctaaacagactcctgggtttgttggggctgacttagctaacctattaaacgaagcggctttattagctgcgcggcggaacaaaactgagattgatgctgctgacttagatgaagcagaagaccgggtaattgctggaccagctaagcataaccgtgttcaatctgaacaagaacgaaagactgttgcataccacgaagcaggtcacacgattgtgggtcttgtattaaatgacgcacgagttgttcataaggttacaattgttccgcgtgggcgtgcaggtggatatgctatcatgcttccacgtgaagatcagatgttaatgtcgaaaaagaatgcgatggaacaaatcgctggtctgatgggtggacgggctgctgaagagcttgtctttaagtcacaatcttcaggagcttcgaatgactttgaacaagcaacccaaattgctcgttcaatggttacccagtacggaatgagtgataagattggtccagtagaactgcaaagttctggtcaggtctttacaggtcaaggctatgaccaatcgccttactccgaaaagactgctgctttagttgatgaagaagtacgtcgaatcttaactgaagggcacgaaactgccttacacattattgagacgcaccgtgagcaacataagcaaatcgctgaagcattactcaagtacgaaacgcttgatgaaaaacaaattcttagtctttataagactggaaaagttcctgataaggatgtggctgctgaagacgaagaggcacgtgcacaaacctttgaagaatccaagcgtgaacttgaacgattggaaaatgagcgtcacgatgaagcaaaggataatcaaaatgattcatccgatactaagagtgacaactcaaatgattcacaatcaagtgatgattcagacaattctgaagacaagtaaactattgaaaagacggaagatacaaaacctgattggtaggtggtggtcttccgtcttttctttgggttaaattttaaggaggaatttaaaatgaaaacaacagattatttagtaaagtcaatgaccaaggatggaaagtttcgggcttatgctgtaaatgctacccaagtcgttcaaaaggcacacgaaattcatgatacatggagtgcttcttcagctgctcttggtcgaacgttaattggaacgattctcttggctacttctagcttacaaggggaagcaggaatgacggttaagattcaagggaatggtccggttggctttattattgcggatggaactgctgaaggaaccgtaaaaggctacatgggtaatccacacgtttctttaccagcaaatgataagggaaagattgacgttgcaaaggcaattggtaatcaaggtactctttctgtaaccaagatggctcctggcgacaagacaccttatactggcgaagtaaatttagtttctggtgaacttggtgatgactttacttactaccttgctcaatctgaacaaattccttcagcggttggtctttcagtattcgttaaccctgatgaaaatattgacgttgctggtggcttcatgattcaagtaatgcctggtgctagcgatgaagaaatcagcaaacttgaaaagacattgaagggcttgccattggtatcacagatgttacgtgatggggatacgccagaagatattttaaagaaaatttttggtgatgacttaaagatccttgaaacaatgccagttcgttatgcatgtgattgctcgaaagaacgttttgcccacgcccttgcaagtatttctaaagatgatatgaagaagttgattgacgaagaccaccatgcggaagctgtttgccaattctgcgggaagaagtacgaatttaacgaagacgaattaaagaagatctacgcggaaatgactgcgaatgatgataaaaaatcaacagatgaaaagtaatttttggtgctaagcgcgttgatatgctatgatagttgagttatcggacaattaaaaatgaaactggatggccagcacagtttcttaagcagtaatgaggtgaaaaaatgaagtggaagatcggtaacgttgaaattcctaatcaagttgttgttgcaccaatggctggagtaaccaattccgcctttcgggttatctgtaaaagatttggtgctggctacgttgtctgtgaaatgatctcagaccgtggcattatgtaccataatcaacgaactttaaatatgatggatgtcgacccggaagaacatccgatgggaattcaaattttcggtggaactaaagagacattagttgaggctgctaagtatgtggatcaacatacagcagctgacgtgattgatataaatatggggtgtcctgttaataaggttgtaaaaactgacgcgggtgcacgatggttactggatcctaataaagtctatgaaatggtgtcatatgttactgatgctgttaagaagccagttaccgttaagatgcgaactggttgggacgacaagcatattttagctgttgaaaatgctttagcagctgaacgggcaggagctagcgcgattgcgatgcatggtcgaactcgaaaacaaatgtatacgggacaagcagattggaatatactaaaagaagtagcgagtcaattgaaaattccgttcatggctaatggtgatgtgaagacaccagaagatgctaagaagattcttgatatgactggcgcaactgccgcaatgatcggtcgggcagcgatgggtaacccatggatgctaaagcggactgaacattacttagcgactggtgagctgctcccagaagcaactccagaacaaaagattgaaatggctaaagatcaccttaatcgtttagttgatttaaagggtgaatatgttggtgttcgtgagttccgggggttatcgacatactatatcaagggtattccgcgtgctgcccggactaaagtagcgttagtcgaggcagaaacacttgatgaaatgaacgatatttttgaccgctttgctgaacaaactgcagaacgggctgcaaaaagacagcaagcctaattacgaggaggagaacttaagtgtcacaagaactagatcaaatgcgcgttcggcgtgaaaaaatggaagagttaaaagaagcggggattgaaccatttggccgccgcttcaaacgagaccatcttgcccaagacttgcatgataagtttgatcaatacgataaagaagaattaaacgagatgggcgccaaagtaattattgcgggtcgaatgacaagaaagcggagtagtggtaaggctggtttcgctgactttgttgatcggactggtaagattcaagtttacgctcgtaaggatatggtcggggatgaaccttaccatgttttcaaacggtcagatattggtgacttccttggaattgaaggggatgttatcaaaacggatacaggtgaattaaccgttcgtgcacataaaattaccttcttgtcaaaagcattgcgtccgcttcctaataagtgggatggggttactgatcctgaaactatctatcgtcagcgctaccttgatttaatttctaacccagaaagcttcaagcgtttccaccaacggacagcgattatcaaggccgtccggaaatacatggatgataatggctttacagaagttgaaaccccaattttgaacacccaagctggtggtgctaatgcgcgaccatttatcactcaccacaatgcgcttgatattgatatgtacttgcggattgctaccgaattgtaccttaagcggttaatcgttggtggctttgaacgagtatacgaattgggccggattttccggaatgaagggatggaccctcaccataaccctgaatttactacaatggaaacttatgctgcttactttgacttccaagatgttatggatgaaacagagggaatcgttaaggcagcagctaaagttgtttcagatgatggaaagattacttaccaaggacatgaaatcgaccttggagggaactttaaacggatcacgatggtggatgccgttaaggaaaagactggcattgacttcagcgatgaatcaatgacggacgaagatgctaagaagttagccgatgaacacaaggttgaatataagccttactggacaaaggggcatatcttgaacgcattctttgaagagttcgttgaagatacacttattcaaccaacttttgtctatgaattccctgtcgaagtttcaccattagcaaagcggaatgctgataatcctgcgatgactgatcgtttcgaattgtatgttgatggtagcgaattggcaaatgcctttagtgaattaaacgatccaattgaccagaaggaacgttttgaaatgcaagcaaaggaaaaagctaacggtaatgatgaagctgaaccagtcgacttagattacgttcaagccctcgaatacggaatgccacctactgggggacttggtatcggaatcgatcgtcttgtaatgctccttactgatgctaaatctattcgggatgttattctcttcccaacaatgcgtccagaaaaggaagctaagaacgattcaaagaaaaagaagaacaagaagaagtaagctgaatggttgatgaaaaattagcataaatagataactcgtattccatttttatggggtgcgagtttttttgttttagatatgatagaataactatcaatttagagaagaaatgaggggaattgatgggagaattagaaaagttaaagcaagactgtatagtaaaacaaaagcgtgggttgcatataataatagcttcgatcgcagtatggggcggtattcttgcagtagaactacttaatgttcccgttcttactaaaaacttattcgtatttatctgtacggccttacttttaccagtatcttatttcatatctcgattgattaatgtggattttcaaaataaaacaaatccgttgactaaattggggatgttattttcgatgaatcagcttttgtatcttctaattgcaatgtggatttatccgactattcccaataaaatgctaatggtgttagcgataatatttggtgctcatctactgccatatagttggttgtataattctagggcttatcttatttcatcgatagtaatttcaatattagctttattggtgggaattaattttaaaccgtttattttagcatcagttatgcttgccatggtagcagcattttgcattaccttaatattagaaaatcatcaacttgactgaagggctccgatccgtaaagaagatcgaagccttttttgctacattattttaattcttgttaagcttactaatagtagaaaaaacaattgcaaaaagagactaatagttatcaagggatgttcctaacaatctatccaagaagatataaaaattgaattggtaaatacatcgagttactaaccgagtttaatattgatgctttcctccatactaattaggtgattttcgggatggaaaagaaatgctaattggtaagaatggtagaggaggcgggcaaacttattaaaggaatagtgagtttaagaagctaatagacagtaatgaaaataaaattcaaaaaagttaaaaaaaggtgttgacgaaagaatgaaatccatgtatagtagttatcgttgtcaaaacagctaagtgctgttgagatggattaacaaaaaagttaaaaataattgttgacatcgacttggcaacatgatatattaataaagctgctgattgagttatcgatcaaaagaaattcaaaaataattaaaatttcttcttgacaagctaatctaatacatgttataataaatatgttgattggctgcttaattagccaacaggtagacctttgaaaactgaacaaagtttcgacgaatcaaatgtgtagggtcttcgatcacgatgtgatttgaagcaaaacatttgcgaagtcaattcgcttaataacaaagataattgagagctattcaagttcttatatattttatatgagagtttgatcctggctcaggatgaacgccggcggtgtgcctaatacatgcaagtcgtacgcactggcccaactgattgatggtgcttgcacctgattgacgatggatcaccagtgagtggcggacgggtgagtaacacgtaggtaacctgccccggagcgggggataacatttggaaacagatgctaataccgcataacaacaaaagccacatggcttttgtttgaaagatggctttggctatcactctgggatggacctgcggtgcattagctagttggtaaggtaatggcttaccaaggcgatgatgcatagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaagctctgttgttggagaagaacgtgcgtgagagtaactgttcacgcagtgacggtatccaaccagaaagtcacggctaactacgtgccagcagccgcggtaatacgtaggtggcaagcgttatccggatttattgggcgtaaagcgagcgcaggcggttgcttaggtctgatgtgaaagccttcggcttaaccgaagaagtgcatcggaaaccgggcgacttgagtgcagaagaggacagtggaactccatgtgtagcggtggaatgcgtagatatatggaagaacaccagtggcgaaggcggctgtctggtctgcaactgacgctgaggctcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgctaaccttagagataaggcgttcccttcagggacgcaatgacaggtggtgcatggtcgtcgtcagctcgtgtcgtgagatgttgggttaagtcccgcaacgagcgcaacccttgttactagttgccagcattgagttgggcactctagtgagactgccggtgacaaaccggaggaaggtggggacgacgtcagatcatcatgccccttatgacctgggctacacacgtgctacaatggacggtacaacgagtcgcaaactcgcgagagtaagctaatctcttaaagccgttctcagttcggactgtaggctgcaactcgcctacacgaagtcggaatcgctagtaatcgcggatcagcatgccgcggtgaatacgttcccgggccttgtacacaccgcccgtcacaccatgggagtttgtaacgcccaaagtcggtggcctaacctttatggagggagccgcctaaggcgggacagatgactggggtgaagtcgtaacaaggtagccgtatataggagaacctgcggctggatcacctcctttctaaggaataaaacggaacctacacatcgaagaaactttgtttagttttgaggggtttaccctcagagcttgtactttgaaaactaaatactatctaatttctttattaacaaaacaataaaccgagaacaccgcgttatttgagttttaattaacgaattataatcgctaactcaattaatcagacaatctttgattgtttaggttaagttatgaagggcgcatggtgaatgccttggtactaggagccgatgaaggacgggactaacaccgatatgcttcggggagcggtaagtacgctttgatccggagatttccgaatggggcaacccaatcagcttagtcgctgattacttgactagtgaatacatagctagcaagaggtagacgcagtgaactgaaacatcttagtagctgcaggaagagaaagaaacatcgattccctgagtagcggcgagcgaaaagggaagagcccaaaccaacaagcttgcttgttggggttgtaggactgaacattagagttaccaaagtgcgacgtagtcgcaacagttgggaagctgtgccatagagggtgaaagccccgtagacgaaacgtcacactctctgttcaggatcctgagtacggcgggacacgtgaaaccccgtcggaacccgcgaggaccatctcgcaaggctaaatactccctagtgaccgatagtgaaccagtaccgtgagggaaaggtgaaaagcaccccggaaggggagtgaaatagttcctgaaaccatgtgcctacaagctgtcggagcccgttaatgggtgacggcgtgcctcttgcagaatgaaccggcgagttacgattgcatgcaaggttaaggtggaaaaaccggagccgtagcgaaagcgagtcttaaatgggcgtaaaaagtatgtagttgtagacccgaaaccaggtgacctacccatgtccaggttgaaggtgcggtaaagcgcactggaggaccgaacccgtgtcagttgaaaatggctgggatgaggtgtgggtagcggtgaaattccaaacgaacttggagatagctggttctctccgaaatctctttagggggagccttgaggtaaagaatcgtggaggtagagctactgtttggacaaggggcccgtcatgggttaccaacttcagataaactccgaatgccatcgatttatactcaggagtcagacgatgagtgataagatccaccgtcgaaaggggaacagcccagatcaccagttaaggtccctaaatatatgctaagtggaaaaggatgtggagttgcatagacaactaggatgttggcttagaagcagccaccatttaaagagtgcgtaatagctcactagtcgagtgatcctgcgccgaaaatgtaccggggctaagcatattaccgaaactgtggatgtgcactatgtgcacgtgataggagagcgttctaagggcggcgaagtcagaccgtgaggactggtggagcgcttagaagtgagaatgccggtatgagtagcgaaagacaggtgagaatcctgtccaccgaatgactaaggtttcctggggaaggctcgtcctcccagggtaagtcgggacctaagccgaggccgagaggcgtaggcgatggataacaggttgagattcctgtaccagttaactgcgtttgacgatggagggacgcaggaggctaagcaaaccgtacgactggaagagtacggccaagcagtaagtcaggatgtgagtcaaatgtttacatccgtgttgacaagctgtgatggggagcgaaattaaagtagcgaagttgccgatgtcacactgccgagaaaagcttctaaggagtagttaactgcccgtaccgcaaaccgacacaggtagtcgaggagagaatcctaaggtgagcgagagaactctcgttaaggaactcggcaaaatgaccccgtaacttcgggagaaggggtgctggccgcaaggccagccgcagtgaataggcccaggcgactgtttatcaaaaacacaggtttctgcaaaatcgtaagatgaagtataggggctgacgcctgcccggtgctggaaggttaaaaggatgggttagcttcggcgaagctcagaattgaagccccagtaaacggcggccgtaactataacggtcctaaggtagcgaaattccttgtcgggtaagttccgacccgcacgaaaggcgtaacgatctgggcgctgtctcaacgagagactcggtgaaattgaaatccctgtgaagatgcagggtacccgcgacaggacggaaagaccccatggagctttactgtagcttgatattgagtgtttgtactgcttgtacaggataggtaggagccgtagaagtcgggacgctagtttcgacagaggcgctggtgggatactacccttgcaatatgaccactctaacccgcagcactgaacgtgctgggagacagtgtcaggtgggcagtttgactggggcggtcgcctcctaaaaggtaacggaggcgcccaaaggttcgctcagtatggttggaaatcatgcgcagagtgtaaaggcacaagcgagcttgactgcgagacagacaggtcgagcagggacgaaagtcgggcttagtgatccggtggttccgtatggaagggccatcgctcaacggataaaagctaccctggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgtaggaaatttgagaggacctgtccttagtacgagaggaccgggatggacataccgctggtgtaccagttgttccgccaggagcaccgctgggtagctatgtatggacgagataaacgctgaaagcatctaagtgtgaaactcgcctcgagatgagatttcccatttccttcgggaaagtaagacccctcagagatgatgaggtagataggatggaagtggaagtgccgtgaggcatggagcggaccattactaatcggtcgaggacttaaccaaggagcggtaaggtttattggaagagaatagataggatttagttttgagagcacaagctctcgtccgaagggacaaagagtgtggtgatgatggcttgaaggatacacctgttcccatgccgaacacagaagttaagcttcaacacgccgaaagtagttgggggatcgctccctgcgaggataggacgttgccatgcgttattccggcatagctcagttggtagagcacctgactgttaatcaggttgtcgtcagttcgagtctgactgccggagtcgatgaagatgttgactaccttcggttagttaacatcttttttttgccaacttagctcagctggtagagcatctccctcgtaaagagaaggtcggaggttcgactcctctagttggcattataaagagtttataaccaattagaagtctacagattaagccgataaagcttattatgtgggcttttttgtatgcttaagaagttaagtgaattgttccgaagttttatgaattattattctaaacacaattttaaccacacaaaaataatacacatttagagagtaagcagtcaataacagtacgtctagcactagctaccctggatctcctatactgagactatcatcagtaaggagatttttatgtatgacagaacaaaatgaaattattaccccagttttcaaaaacaagccaagtaatttacaaaagcgttcttttacggcacgccctgccgtaaaaattaatgtgaatgaagtcgaattaacgattttcaaggggactaattctgttttagcttcggatatcgttaaagtggttattcgttatgctcgttaattggcatgacccagatcatatctatttagtctgtggaaaaacagacatgcgaaaaggtgttgatgggctcgcaatggtaatcgctgagaactatggattagaattatataataattcgcttttcttattttgcggcggacgtaatgatcggtttaaaggattgttttgggatggcgagggctttattatgctctataaacggtttgaaaatggccaccttagttggccgagaaacagtaatgaagccaaagaattatctgctcaacagctcgactggttattgcaaggactgaacccattaccaattcgtaaaattcaagctgttcgactgggaagtttttattgagttacctctatttaaaagaagaattctttgatataattaccaaagaataattcaaaggaggtgacgtaccatgaagcaaacagcggaagaacaaatcaaagaacttaaacagcaattagctatggccaatgaaaagattgctcaattaacagctattatcaaacttcaaaagaaccaaatatttgggaaaaaaactgaagtaatggagcccgtcgttgatggacaacaatccttatttagtgagcaagaaatggatcaacttcaagatcctgatatttcagtcacggaagtgactgaaaagaaaataaagcaagtggtgcgtcaccggaaagcaaaacaatctggtcagcggaccacttttttagatggtttaccacaggttgaagaagttattccattaaaagatactaactgcccacactgtcatcaactaatgaaaaaagtgggtcaacatgtatatagtagagaagcacggttaaaaccagctgaattatattgtgtgaatttgattcaagaaacttataaatgtaatgagtgtattaattctaatggtagcgatgtacttgtcagtagtaagatgccacagagtcttttaccccatagttacttttcgagtactattttagctaaagtagcagagttgaagtttaatcttgctttaccgtttcatcgtcaaattaagttttggcaagccgtcggcttacgagttgatgctcgattattggcgactaacattattaaggttagtcaaacctaccttgaaccgttgtatgattatttacaggaattaatcagaaaagaatcggtaattcatatggatgaaactccattcaaggtaattgatgagcctaatgaaactggctacttttgggtaacgcgatcaacaaaagaattcagtaagcatcaaattatcatgtttcattactataatacccgcgcgggtaaaaccattggtcaaattatcggtcatcaatatcgtggaattattatgtgtgacggttatggtggatatagtgatcgattatatccccaggcaaaatttgggtcatgtttagttcatattcgacgtgaattttatcacattacatgtttattgaataaggagcaattgaagaactccaaagcataccgagttttacagctaatgcgaccgatctttcatgaagagaaacaattaacatattccaatcataaggaaaaactagtgcaacgtcggttgcacgtgaagcctttgatggataagttatatacttatttagaaaatatcagttttcctcaaggacggttgaaagctgccattaataatgctttgaaactaagaaagcgagtatatcaaatatttgaagatggtcgagtgccgttaacgaataatccggttgaacaagcgattcgtccatcaactcttattcgaaagaatagcttatttgcgaaaagctctgctggagctcaggcaaatgccattttctatactttggtggcaactgcaaaccagaaccatttaaatatctacaaatactttaagtatctttttgattacttaccaaaccgcaaggacgcaggacttgaggcttatttgccatggtcaaaagaaattcaagcagaatgccataaataaaacggggtcatgaattaccattttcggtagctcatgatcccaattttttcaatccgtaatgttactgactgcttactttagagaaggttctgaccattgatatatcaacattttggttttaaattgtgtgatagtggaaaactccatgttcatttactgatattgattaatgcagtaaaaacaaatgataaaaccgtactaacaagtcacttttttgtatatcgaacagggaaaatgatctaattccgttaatgaagccagcccacgtaaagatgctaagacgataattacgcgatcaagttaggaagtacaacaaaaacagcgaatttaattacaaaaataagaaaaagagagtgaaaaacaatcagtctaataataagcattatcaagtaaaaaacaaaaagatgatttgctatttggtttcaagaagctttaatattattttactcaaatactctgttttagaatagatgtaccaagagcagttgccaatcttaaaagggtagttgaattaacatcatttgaaccaccacgctcaaggcgagaaataaaattatatgattatatagtagagttgctaagcggatcgagctaaaagcgcatgcgattcattgaaacttaatttcagttaaaaaatcagcacctaccttttatgttattctcttatgattaagtagagtagaaaatgaataaactcctacttgaaaatatttctagacaaattttaaattagcttgacgggtataaggagataatatataattatatccgttgagttattccggcatagctcagttggtagagcacctgactgttaatcaggttgtcgtcagttcgagtctgactgccggagtcgataaagatgttagctgtttggctagcatctttttttacgccttctaaatatctttttaatagtctaaattgtatatctccagtttttaacgatagattattaatttttatatcaaaaaaattgtagaagttttaacatgagaatatactaaaactgtaactagtttcatatgtagtttaggagaatggaggtatttataatgcgatttagtaaagcaatccttgttgcaaccagcataattgcaattgggctatgtacaagtggctgtagtagttctagcacgagttccaacagtagcaagagcagtgcccaagtctcatcagcaaaaaaagaggagtcacatattgtgggctcatatcgtgatgatgccgatggagctgctattacccttaattcagatggaactgggacatatgtaatggcaaatccgacgcaggctgatattcatgatcaattaacctggaaaaaggaaaagaataattacatcattaacttaaatgatagtaattatgatacaccgattgatgcgcggctaaatgaagataatttgagccttgtaggtaacgatgagtggcctaatcagtcatttaagcgagttcacggggactttgacgttgataatttcttaaaagaacaacatgcgaaaaacaacagttctacaactaaggatactcattctaaggaatcatcgactcatgcccgtgcagcacttaagaaatgggcgagtgaccaccacaaagacaccagcaagattgataatttgaaggctacgactgacctatctgagccagatgaggggtgggcctttgttgatgataatggaactgaatatgccattgttcgaaatggaaaagtttacccacgtccagttattgacggagatacttcatctaattaataatcttagcgacaaacttaataaaataaacaattatagctcatacatgcggttgcgttctcatcaaaaacttatttttcaattgacgatgttttgaaacacgtttataatagtactattctgaattttattgttaaagttttttaatgtttagaatacgtattcaattaacattgtgctaattgaaaagtgaaattatttggaggaattgtatgagtaaacaaaagaatttggatacctccttctttggacaaccgcgtggattgtcgacattgttcttcactgaaatgtgggaacggtttagttactacggaatgcgggctatccttctattctatatgtactacgctgttaccaagggtggtttgggcatggaccaagctaccgcagcatcaattatgtcaatttatggttcattagtttacctggccagtgttgtcgggggatggttatctgaccgtgtatggggatcgcggcgaacggttttcatcggtggtgtccttattatgtttggacatatcgctctgtcattaccatttggtgtgtcagcactttatgtatcaatcgctttgattgttattggtaccgggttattgaagccaaatgtttcagaaatggttgggggcttatacagtcctgaagatcgtcgtcgagactctggttttagtatgtttgtcttcgggattaacttaggggccgctgttgctccttgggctgttccttgggctgctaatggttttggcttaaaccttttccatggtgaaatgaacttccacgctggtttctcactagctgctatcggaatgttctttgggttagtacaatatgtagttgacggtcggaagtatctttcaaaagatagcttgtatcctgatgatccgatcgataaggaaagtttacgtccagtaattatttggtcaattgttggtgttgttgcattagtgatcattcttggattgcttgcggcaatgggtcaattaaacatcaataatatcattacgatcattacggttattgctattgctttaccaatctactactttgtaatgatgttgaattccaagaaggttacaaaagatgaaaagtcacgggttgttgcttacattccacttttcattgctgctgctatcttctgggcaattgaagaatcaggttcagttgttttagccctctttgctgaacaacggactgttttacacattggtggctggcactttgctgctgctaacttccagacattgaacccattatttattatgatcttaacaccattcttcgttgcactttgggatcactggaaaaaacaaccaagtgctcctggtaagtttgctgctgggttagtaattgcaggtctttcatatgtttggatggcacttccagcaatgattcacggtacaaccgccggacgggttagcccattctggttagttggttcatggttcatcgttgaaatcgccgaaatgttgatttcaccaattggtctttcagtaactactaaacttgcaccaaaagcatttaagtctcaaatgatgagtatgtggttcttggcggatgctgctggacaagcggttaacgcccaagttgttaagtactactcatcagctacagaagttccatacttcttaattatcggggcagtaagtatcgtcttcggattgatcctttgcttattcgttaagaagattcatggcttaatggatggtgtagactaaaaattatattaagagatcgagaataattcttggtctctttttttatgaggtgagttatgaaaatcgcagtaagcagtgaccttcatttagatttaaatcatgctgatgttgcagaaattattactcaacaggcacattatttaacccgtcaagaaattgaccattacttttttgtgggggatgcctttaatgattttgagcaaaccagcgcttgttttgcggaactacaatcgcaattacctaccacaaaggtccattatcttgccggtaaccatgatatgttaaaaggggtcacttatgagcaattagaaaatttagatgatgatctatattttcataaccgatttatcgatattccccaaacaaactggcggattatcggtaacaatggttggtatgattattcgttttcaatgtatgaaagtaatgtaaaagaggtcgcaaaatggaagcgggcatattgggtggatcgtccaattatgcagccaatgaatgatccagaacgaatggcgattgtcttacaccaagttgaagaagccctaaaacaggctcacaatcaacaaaaacaggttatctttatgacccacttcgcaccaattagagaagctctcccgcatccacttattgagtctgcacggcgacaacggatgtgggagatgacgacagcgatgttgggcagtaaacacttaggagcgttactagctagattcctggaagtaaaagcagttttctatgggcatcttcattatgctcaaccattaattaccgttggaaatattgaataccgtaatcaagcagttggcgtaagacgcaaaaatagtgaggactggaaggggaaaagcctattagatcaatggattagccacctttatactaaaaaaatctagttttttcaaaaaaataagaaaaaacacttgcaatgaggttggaaattaggtattataataaacgttgattgatacgaaatatttaatcaagcaacttcttggaggagtagcgaagtctggttaaacgcgacggtctgtaaaaccgttccttcgggttcggcggttcgaatccaccctcctccatctttattattgggctatagccaagcggtaaggcaacggtttttggtaccgtcatgcgctggttcgaatccagctagcccaactgttattgaaaggctaagaaaaacatctgtttttcttagccttttctagttcaaaattttattaagctatatgaaaaaaggaatgacagccaatgcctaaacaaggtcattttgcaaaaagcatgcgaactaaacaaataaatgattttaaagtgaaacgcaatgcgactggtgcgaccattgatgatgaacagttaacagatttcttagtggttcgctttgctttaacagctaagaagagggttggatccggggctcgagaaactgttcaacggttcttgattgaaattggtgattctttacaagaaaatgatggagatttacagacaatcattccaaatttactagcgagtcttaatgcccgggtaccttggcaattctatctagaaattttgggagagtgggatttgcttcaaaagtttttacaaaaagaacttcctgcagtcccgttagaaaaacgtctacgaattaagcacccagtcacaacccaggaaatggagacgttaattgcaaaattattggcaaaaaagattactgcaattacgtttattaatcagccaggagtggatcaaaataagaaagatcagatggtgacaatgatgctaacaacgatctatcatgatcaaacgattgaatgggaaaaagtgcggttgttactggcgccatttaaatttgaaatcgctcctgaactagatgaagaaacaaaagactggttaaagaaattagcagaaaaataataacgttgactttcgttctgcttccttggtagaattaaatcgttattgcagagctgtggtggagtttttatcaccgtggctctttttattttgatttgaaggaggaagcggaaagcaatggcagaaaaaaactattcacgtatttatctcgcaattggttcccttgcattactaacgtttatcggaattttgaatgaaacatcgatgaacgtcacatatccagaattatctgctcagtttaatgtatcgctcgatgttattcagtggattacaactggttatttattgatggtaacaattacgatggggacgactgcctatctattacgccagtatcaagcacgctgtttgcacttatttgcagtatcatttttcattattggtgacttgatgtgtgctttgactggtaactttcctattttgttaacggggagattgattcaagcaattgctactgggttagcaacgccaattatgttccatttaatttttacggagattccgcgtgaaagaattggcatgatgaccggaatggctgcaatggttatttcgtttgcgccagcgttgggaccaacatatggtggggtcgtttcagaaatgctatcatggcggatgatcttttggattttactaccaattgttttgattagtcttgtatgcggtcaactttttattcgtaataaaccgcttggaaatgataaagcatttagttatggaagcttaattacactggcaattgcccttattagtataattagtgcagtttcttcaattgggaaacaaggatttggaaagcagttttggcttttattattggtagcaattattttctttagcgcctttatctatatcaataatcatggtaaatcagaattgtttgacttaagggtgtttaaggttgtcccattacggctatcaactgtcacttattttaatttacagtttattaatattggaatttcgcttgttattcctatttacgttcaatatgttttgcactcttcggcaattgtcgcgggtcttattttatttcccgggtcattaatcggtgcttttatctcgccatttgctggaactttggctgatcgttatggttttgctacgccagttatttctgggggaactcttttggttattgggacaagttgcttcagtattttccaacgtcatttaacgccattactaataacgatcttctttgttattttgcgaattggatttaactttgccttttctaatacgatttccaatgcctcaatgttagttcaaccgcaaaatgcccccgatgtaaactcaatctttaatatggtccaacaatttgccggctcactgggaactagtcttctggcctccacaattgctttattccaaatgagcaacagcggttcactgatgggacgtacgtacgccggaggacgatttgattttatcttattgggcgttttagcaatcgttactttattaacaatggttactaattatcgcatgcaacaaaagaaggaaagtatttctcaataagtggttgaattagcctgacaagaatgtaataatgtggcttgattaatacaagttattacaggtttttaaagaaagtgactataagttaaaatgatacattctatcgttcactttatggtgagcaatcaggtttttacgctgtttatttgtcttgcaattggctttttgattggaaactataaaattgcgggtaaatttaatattggagcaacggtgggaacgttaattgtgaccttaatcgtggggcagattgggagtttcccccgggatgaaatgttgggaacgattttctttggcgccttcatgttctctgttggttatcggatcggaccccagttattagttagtttgaaattatttggggttcgcattttaatcgctagtattttctggatggttgttgcgttcttagttgggtggagtcttttttctgcctttaagattggcccggggatcgctgctggagttatttccggggccctcacccagtcagctaccgtggccagttcgttgcaaacgattggatcattgccagttagtcaaagcgttagggcaacttatgaggcgcagctcccggttgcttatgctttaacatacgtttttgggacgttaggggtaattatctttttacgtgacctagcacctaaaattttggggatttcaattgctgaacagggtcctaaaatggctgaacattatcactttcatgctaaaaacccgaacccaacgtggcgacgaacatatcgcattgcagatgattcaccgcttgtcggcaaaacgcttgaggaatttaatcggcggtctaattaccggattattgggttagctgcttttcatgatggcaaaatgactgaccaccttgaatatcaattgcaggttggcgacttgctaactgttattggttacgccgttcatttcgatcggttaatgcgagtgccaggtttaacagaagtattgacgccaaccaatgcgccgcgtgaacgagcttttgttctggggaaaaactttaaaccgagtgaattagctcttctgcgtcaacacggggtttttgtgaatattcaagacccaatcagtggaaatcaacaattgattaaccagttgcgaccaggggatgtgatttcattgactgggaatacatcgcgaaccaaggcaatcttaaaaaagatgggacgttggaaagctgcagatacagcaatgaattattctttattctctttaggaatcggttgtgcttcccttttaggaattatcgggctaaaattaaatagtattccgttgcaactagggaatggaacggcggctttgatcatgggactaatcttgagttcgtggattgaacgtcaccgtgaccgtaaatccatccctgtaacggtaaccagctttcttcagagttttggactaacgctttttgtggggacagttggtttacaatcagctcaagcatttacaagtgcaattaagtcgttaggtatcggggtcttatttattggggcgatgatttcaataatgccacatttgctaacgatgttctttggacgctatgtattgaaaatggaacctcttgctttaattggagcaatgacaggttcgggaacgatcgcagcggcaatgaatgagatttcgcaaaaagcaggtccggaaggtggcgcatattatgcggctgcctttactccggcgtttgtagttggtaatattggaattacattactagggccgatttttgtggcgctactatcataatttatcgcttagaaagggcgtgcaaaattataatgcaacaattttttacaattttaggtggaatggggacgctggcaacagagagttatgtacgtctgttagataaaagaacgccaattcattgtgatcaagattacttaaactatttagttgttaaccatgcaaccgttcctgatcgtactacatggattctcgatcatagtcaaccagatcctaatgaggccctgattgaagatattaaacagcaaagtcttttgaatcctgcattctttgttttaatttgtaatacagcccattactcttttgataagttacaggcagcaacggagattccgattctcaacatgctgcaagaaacggttaacgagatcaagaagattaagccggatgcaaagcgggttggcctattagccactaagggaactttggcagctaacttatatgatccttatattgagaaggctgggtatgagcttatcaagccaactcctgagattgccgatatgacagaagacttgatttaccatgatatcaaagaggctggtcattctgatggcaagaagtatcatgagctagtacggaaaatgattgaagaacaaggagtagatgtagtagttttgggttgtactgaattatcttttgcagaagagatggaccctgaaactaagtaccctgttgccgattcacaatcaattattgttgatcgctcccttgaacgcgcattgaaattacgccaaaaataataaaaattaaaaattagagaccggggaaggggaatagttccaacggtctctaatttttattaattttttgccgatattttaagaaattggtctagatttttgggaatggtgtaaaatatacacatgcgcaatgtttagcaaacaatggcgtaaggaggaaagaaaatgagttcacctgtttatattcaaattcacaatcagttaagacaaaacattgaagatggtgagtggaaagttggcgataaaattcccgctgaacgcgaactcgctaatgattttggcgtcagtcgaatgactttgcggcaagcaattcaagcattagttgatgaaggaattcttgaacgaagagttggctctggaacttttgtcgctaatcgcaaagtccaagaaaagatgtcaggaataacgagctttactgaattaatgcacgcgacagggaagaaagctgctagtaagacaatttcttaccacttgacgatcccttcgcaaacagaggttgaaaagctaaagttagccccagatgaacaggttttacgaatggaacgggttcgttatggaaatgatgtgccaatttgttatgaaatcgcaaccgttcctgctaacctcgttcaaaaatttagcaaagaagaaattaccacatctttttatcggacgttagaaaaaaaggcgaacctttatcctggtcatgcaacccagcatatttcagcaacgaaggcgacggaaaagattgctaattacttgcagattaaacgtggagatgcgctcttgcgaatgacccaactatcttacttgcaagatggtcgtccttttgaatatgtccacactcaatatgttggatcacggtttgaatttgtctttgaaaagtaatcaagacaaatccatgttacaatactgattaacgatattacttttgagaggaattatactaatgaaatttgattatccggatgatagccttaccctgcatactgatgcgtatgaattgagtatgatgcagacctactggaaaaaaggaatgggtaaccgccgtgctgtctttgaggccttcttccgtaaaatgccatttaataatgggtacgctgtttttgccgggttagatcacattattcgctatgtaaaacaattacattttactgatagcgacattgaatacttaaagtctacgaatcaatttgatgatgactttctagaatatttacgtaactttaaatttacgggttcaatcaacagctttgaagaaggagatctggtatttaaccatgagcctattattcaggttgatgcgccgattattgagggccaattgattgaaacggcaattttaaatattcttaattatcagattatgattgcgacaaaggcttcacggattaagtcgattgtcggtaaccaaactgtaatggaatttggctcacgccgggcacaggaactggatgcggctttgtggggaacgcgagcagcatatattggtggcttcgatgctacaagtaacgtccgtgcaggtaaattatttggtatcccgatttcaggaacccatgcccatgctcttgtgcaggtatacatgaatgattatgacgcatttaaagcatatgcagaaactcatcataattgtgtctttcttgtggatacttttgataccttaaagagtggggttcctaatgcaattaaggttgctaaggaatttggcgataaaattaactttatcggtgtccgcattgacagtggtgatatggcctacctatctaaaaaagtacgcaaaatgttggatgatgctggtttcccagacgcaaaaatcatcgcatctaatggcttagatgaaaagacaattcaaaacttgcaaatgcaaggggcgaagattgatacatggggaatcgggactaagctaattactgcctatgaccaaccaactttaggggccgtatacaaattagtcgctattgaagatgaagatggccaacttgttgatacgattaagatctctaataatgttggtaaaatgtcaactcccggcaaaaaacaagtatggcggattaacgatcgtggagacggcaagagtgaaggggattatattacattagttgatgaggatcctcgtaatgaaaagtcactcaatatgttcaatcctaacttcccactccagcaaaaagacgtggaagattttactgcccggccaatgctaaagccaatctggcaagatggtaagtatgtttatgatgaaccgaccttagaggagagccgtcaacaccgtttcgatagcttaaatgctttatgggatgaatataaacgcgatttaaacccagaagtatacccagtcgatttatcacagaaatgctatgataataaacttaaattaattcaccaagttcatgaatatgttaaatcattgagtaagtagaggtaatctgtagtgcgaaagtatcaagaagaaataattaatgcattaggcgttaactcgcaaattgatccccaagcagaagtaactaaacgtgttcagttcatctgtgattttctccaaaccactaagatgaaggccttagtattaggaatttctggtggccaagattcaagtttggcggggcggctttcacaattggcagtcgaaaagctgcgggaagagactggcgacaatgaataccaatttatcgcagtccggttgccatatggtgagcaagctgatgagtcagatgcaatgtttgcaattaatgactttattaaacctgataaaataatgcgggttaatattaaggcggctactgatgcgatggtagcatccttaaacgaagcaggcacgccaattagcgattttagtaagggaaacattaaagcccgagaacgaatgattgtccaatatgctattggtggagaaaacaaaggagctgtagtgggaacagaccacgccgctgaagcagtaactggtttttacactaagtttggggatggcggtgcagatattacgccactttctggattggataagcgacagggaaaggccttattacaatacttaggagcaccagcaaagctttatgataaaacaccaaccgcagacttggaagaagacaaaccaatgcgtcccgatgaagaagcgcttggtgttcgctatgatgaaattgatgactacttagaaggtcgtgaagtttcgccagcagctgccgaaaaaattgaaagctggtatcggcgaactcaacataagcgtcacttaccgattgctccatatgatacttggtggaagtaaattgataataaaatgggaggctgggaatcaactcagtctctttactagttttaaggagaatgatgatggaagaggaaacacttcaacttgttagtaaacaattaccggatattcgccctcaacaaattaaagcggccctcggattaatggatgaaggaaatacaattcctttcattgcccgttaccgtaaagaaatgacgggcacgcttgatgaagttcaattacaagcgatccgggatgaatatcaccgggtaacgacattgcgggaacgtcaagcaacagttatcaataaaattaaagagctcgggaagttaaccccggcgctcgaaaagcaaattaacagtgcgaccgaattgcaagaagtagaagacctttacttgccatataagcaaaagcggcagacaaaggcccaacaagctcgtgaacatggcttagcaccgttagcaaattggctgctctcttatcctgatgatgatttaagtgcgaaggcgcaagagtttattaacgatgatgttcctgatgctgagagcgcattaacaggcgcccatgaaattttggctgaagcaattagtgaaatggccacggtacgaagctggttgcgaaattatactgctcaacacggtcaattagagacaagcgtaaaacgtgatggcgaagaaaaggatgaactggggacttacaagcagtactatgagttcactagtccagttcaaaaattgaattcttatcaaattttggcttttaaccgcggagaaaaagaagggattattaacgccaaaatcactttagatgaagaaccggtgatgaattatcttcgtttccgtttgattaaaactagcaagaaaaatgatgcgactgcctttattgaggaagcttacaaggatgcttacaagcgtttcttgggtcctgcaattgaacgggaactgcggcggcaattaacagagggcgctgatgaacaggcgattaaggtctttggtgaaaatctctatcatttattgatgcaagcaccaattaagggaaaagttgtgttaggatttgaccctgcttaccgaaccggttgtaagttggcggttcttgatgaaaatgggaagtttttaactaaggcagttatctatccacacaaaccagcaccagaaaagcaacgcgcgacagcagaaagtgagtttattgacttactagaaaagtaccacgttgaaatgattgcgattggtaacgggacagctagccgagaatcagaacaatttgttgcggaagcacttaaaaagatcaaacggccaatctattatgtcatcgtaaatgaagccggtgcctctgtttactctgcaagtaaggaagcacgtgatgaatttcctgacttgcatgttgaacagcgaagtgcgattagtatcggtcgtcgtttgcaagacccacttgccgaattagtcaagattgatccccaagcggttggtgttgggcaataccagcatgatttgccgaagaaagaattgaatggggaactggaaacaattgtagaacgggcggtaaaccgggtaggagtaaacctcaacacagctagttaccaattattgacgcgaatttccgggcttaataaaacgattgctaaaaatatcgttacctatcgagatgaaaatggacgttacacaaaccggacacagttaaagaaagtgccacggttaggacctaaagcttatcaacaatcagtcgggttcttacggattattggtggcgaaaatccattagataacaccgatgtccacccagaaagttaccaggtggcggaaaaaattattcaagcggcagggattaatgtcgatgagttgggaacgccaagtgctgatgataagttaaagaaaattgatgttaagcagtttacggatgatcaagtcgggactgaaaccgttactgatattatttcttccttgcaaaagccaggccgtgacttgcgtgattcaatgcctgctccattattacgccatgatgtaatgacaattgaagaccttaagccggggatgaaacttcaaggaactgtccggaacgttgtcgactttggagcctttgttgatattggtgtcaaacatgatgggttagttcatgtttcaaagatgagtaagcagttcattcgtgatccgcgagcaatggtagccgttggtgatattgttgacgtatggattgatgatgtcgacttgaagcgtcagcggattcaattaacgatgcttgaaccggagacagtcacaaatgactaatgctgaattacaacaattgaccgaacagtggtcgaaagaatactttgggcgcgaatttacgcacaaggtattttttaataagcggttaaaaacaaccggtggacgttatcatttaagtgaccatcatattgatatcaacccgttaatgtatactgagtttgatcttcataatctgcgccaggtggttcttcatgagttgtgccattatcatttacatctgctggggatggactatcaccatcgcagtaaggaatttaaagctctattgacacaggtgggaggatcaagatatgcgccaccaactagtaaaagaaaggtaaattccaagaaaaaatggcattatatatgtactggttgtggtgttgaaatcgcgcgacaacggcgtttcaacacccaaagatatatttgccgacgatgtggtcacaaatttattttaaaaaattgaaaaaagttgttgccaacgaataggtatcttgctataataatattcgttggttgatatgcggccgtggcggaactggcagacgcgtaagattaaggatcttatggtcgattatgaccgtggaggttcaagtcctctcggccgcactacttaaaaggcattgagtaatatttgctcagtgctttttttgttttaaaatttctgtttaataaaatttacgtaaattttacctctcctcttgctatctcaatcatgaaagcgctatactttagatgttgtagatagtaacgaggagggatttatcaatggatgcagatatcaaatggcttgatgaaccggaaacattccgcgtcaatcaattacctgctcatagtgaccattattattacggtaactatgatgaatggcggcataataatagtcgttttgcgcaaaacttggatggtcaatggcaatttaactttgctgaaaacccgcgtaaacgagaaaatgacttttataaggtagattatgatagtagtagttttggaacaatcgaagtgcctagtgagattgaactaaataattacgcccaaaataattacattaacactttgattccgtgggaaggtaagatttaccgtcgtcccgcatatgcccttagtcctgatgatgcgcaagagggatcatttagtgatggggatgataatactgttggcgaatacttaaaacattttgaccttgaaccttctttacggggaaagcagatccgcattcgttttgatggtgttgagcgtgccatgtatgtttggcttaatggtcactttattggttacgctgaagacagttttaccccctctgaatttgacctgactccttacattcaagatgaaggtaatgttttagctgtggaagttttcaagcatagtaccgcctcgtggattgaggatcaagatatgttccgtttttctggaattttccggagtgtaaacttattagcccaaccacttgttcatgttgaagaccttcatattcggccaattgttactgataattatcaggacggtatttttaatgttgaccttcaacttcacggtgaaaagaccgggaacgttaatgtgcgggttatcgacaatgatggtaatacgctcgtcaatgaaacacaccctgttgattccacggtaaaagttcaggatcaatttttagaaaatgttcacttatgggataaccatgatccttacctctatcaattgttgattgaaattcgtgatgacgaaggtaatttggtcgaactcgttccatatcgttttggttttcggcgaattgaaattaataaagatcatgttgtcctattgaatggtcaacggctaattataaatggtgttaaccgtcacgaatggaatgctaaacgtggccgcgcgatcacgatggatgatatgacgagtgatattcacacctttaaggaaaataatattaatgccgtccggacgtgtcactatccagaccagattccgtggtattacctttgtgatgataacggaatttacatgatggccgaaaataatctggaatcccacgctacctggcagaagatgggagcaattgaaccatcatataacgtccctggttcagttcctcaatggcgtgacgtagtagtagatcgggcgcggactaactatgaaacatttaagaaccacccgtcgattttattctggtcgttaggtaatgaatcatatgctggcgataatattgtcaaaatgaatgaattctataagaagcatgatgacagtcggcttgttcactatgagggtgtttgtcatactcccgaataccgtgatcggatctcagacgttgaaagctggatgtacttaccacctaaagaagttgaggagtacttgaagaacaatccagacaagccatttatggaatgtgagtacatgcatgatatggggaactctgatggtggaatgggttcatacatttctttacttgataaatacccacaatactttggcggcttcatttgggactttattgatcaagccctccttgttaaggatccggtaagtgggcaagaagtgatgcgctatggtggtgatttcgatgatcgtcactcagattacgaattctcgggagatggcttgatgtttgctgatcggacaccgaagccagcaatgcaggaggtaagatactactatggcttacacaaataaattacgcgtgatatatggtgatgcgacattaggacttagtggtgacagctttcattatatttttagctatgagcgtggtggattagaatcgcttaagctaaacggtaaagaatggctatatcgtgaaccaatgccgacgttttggcgggcaaccactgataatgaccgaggaagtggctttaatattcggtctgctcagtggttagcagcggacacttttcataagtgtgttgggattgacctgacagttgataatcaacactttgccgaattacctattgcgccgataaccaatgaatttagtgatccggtatctgctgaaaacgtcaaaattaagtatacttttgagacgctaacagttccggccacgcaagtcactgtaacttatgaggttaacagacaaggtgagattaaagtgacaatgcactattacggccatgaagacttacctggtctaccagtagtaggaatgcgttttatcatgccaacagttgctaccggctttgactatcaaggattatccggtgaaacttaccccgaccggatggcaggagcgactgagggtaccttccatgttgacggtttaccggttactaagtatctcgttccccaggaaaatggaatgcacatggatactcatgcattaacaattacccgcgattccactcaaaataatgctgatcattcgcgggaaccatttaacttaactattaagcaagacgagcaaccgtttgccttcagttgtttaccatatacagcggaggaattagaaaatgcaacacacatcgaagagctcccactcgcacgacgaactgttctcgttgttgcgggggcggtccgcggtgttgggggaattgatagttggggtgcagatgttgaagaacagtatcatattcctgccgaccgtgatgttgagttttcgtttgtattgaatgcaaaataagaggttggattatagtctatgccgctatgttcgtaaaaagttgtataacaaaggtctctaacacccggtaaatccgaacgttagagacctttttgttttaactaatttgtccagctgcaatcccttggaagtatttcttaacatgagtacagaaataataaagaccataaattgcaagaatgctaagaccaactaatgagatcactaataaagcggtgaaccattttgcttgcttaaagtagagggtaacagtattttttcctttacgttgctgaatgtatggagcaccaactgaggatcgctgatagtggcgaagtaggtggccattaaccgttaattgtgattcgtgatacgtaataattggcaaccgaacttttcccgcttttcctgcttcccatgatagttgcaatcctccatgcggcaagacagtatgagtatatttatgggcttcattaatgatttgcccttcgtaagcgtaagaacgaacatatttttgattcatgtacttcttaggaattggcaaatagtcaggacttctcttttcgaccattgttaacaattgaccagggtaaaggtcgtggacagaatgtcgcagggcggtcttattttcacttacgcgggtaatcgcgctaaagctattaaggacaatttctgagtcatagcgggctgcgcgtttataaacatcaattgtcgtaggagtaaagaccagaaaaaccattaacaagaggataccggtgattaattgatttcgtaaatcaatttcttgcgcttttttatcaagagttgtcgcactgatcccaactcctgcgagtaagaggggaaaggcaataattgtcaaccggttaggaaactgcaaagtgtgtccaagtgcgggaatcacatcttggaaaaaggaccaaggagtaaggggagaactaagcaggaggaccaaagaaccaagtaacgtcaggactgtattagtaagcgattttttgaaggtgaataatacgtagatgagttgaaggataaagagaatccacattgcgtagattagataatcgcgcgtactgctaaacattgaaggcaatagcacattatcggcgagactgaaatcggcaggattggcaatattattatggaggttaagcattaataaggctccccagacattggctgttaaaataacggttccgccgactgccttcagcgtttcgatccacattttcttacgattagtcgttataattaacccaataataaaaaacggtgttagggtaatcacgaaaaataaagaacttagcatgtggatctgaatgatgatcgtcatcagggtcatcaattgtagccagttgactggtcgttggtgatcctgaatcatgcgtacgccgcaaattaccatataaggagccagagcagctccccaggcattcatattctgtgctaattcccatcgtggaagccacccaatgttcatatagattagggcacagataattgcaaatgtccttttactatgaacacggatgccaagtcgatacataccgattccacctaatagatagacgataaaggtagtaacgatctgatattgataccaagttcctactacgccaagaatagctccatttaaatatgcaaagagggggccataaacggcattgatgatgcgaccactttgttgaaaactataattactttgaaaatagctaaaattaagctgttgaatttgcttagctgcatcgtaaaaacgattaaagtgaaaaatggagtccgtccctaaaataactccatgtgatacaaactgagggaacatgattaaataggccattgcagcgatggcacaatatggtagcacccaattaattagattagcaattttagatttcataaaattgagaattaaacaaaatcagtttaatttctcctttcctcaaatacttaccttaataattatacggcagaaaagtcgactgtaaaataaccttctgcagctagtttaattgttaagcactagtaaaatgcgctattataagatagtggcaaaggggagtgaaaaaatggcagaattagtaattgtacgtcatgggcaaagtcaagctaaccgtgataatatttttactggctggactgatgttccgttgactcctaaaggaattgaacaaggtgaattagtcggcaaggaattgctaagactaggtatccaatttagtgatgcgtatacgtcctacatggaacgggcaatcatgacaactaatattatcctagaagaaattaatcagttatatattccggttcataaaacgtggcgactaaacgaacgtcattatggagcattgagtggtcggaacaaagatgaagtgaagaaagagattggtgcagaacagcttcataaatggcggcgtggttttaaagatttaccaccacaattaaaagagcgtcagcatgatcgccgctatgatcgcttaggagttaagattccgcttagtgagagtttagaaatgacgctccaacgactcctcccatattggcaagaccatattgcgcctcgtttaattgacggacacaatcagttaattgttgcccatggtagttctttgcgggcactaattaaatatttagatggtatttcagatgacgatattgataaagtggaagttccaaatggcaagccaattttatatcgctttgatgatcatcttaatgtcattaaaaagacttttataacaatggatggtgaaattgatgacaatacacgaattagcaaataacccaacgttaagcggccaagtacgcttgattgaaaatattgtttatggtgcgatggatggtgaggcattacatatgtcgatcttagcaccgtggacgcaacgtttcccgaaacaatatcaaactgaacctcgaccattgattgtctttgttcaaggaagctcgtggcgaacaccaaaaatgggagaagaaattccacaactggttcaatttgttcgggccggttatattgtagcgactgttcaacaccgtagttcaattgatagccacccatttcctgcctttttgcaagatgttaagactgccattcgtttcttacgggccaatgcgcaaaaatatgcaattgatccgcaacaggttgcaatttgggggacttcctctggagccaatgcggcaatgctagtcggcttaacgggtgatgatccgcgctataaagttgacctttatcaagacgaatcggatgcagtagatgctgtggttagttgttttgccccaatggacgtggagaagacgtttgagtatgatgctaatgttccaggaaataagttactgcaatattgcttattagggcctgatgtatcaaagtggccagaaattgaaaagcaaatgagtcccttatatcaagtcaaagatgggcaaaactacccaccattcttattgttccacggagatgctgataaagttgttccatatgaacagatggaaaaaatgtatatgcggttgaaggataatggaaattctgttgaagcgtaccgggttaagggtgcgaaccatgaacgagatttctggagtccaacaatttataatattgtgcagaagtttcttggcgatcaatttaaataaattttaggaattgtattgacaacttattttttataagttatgattttgacatactaagttaggaggaacacgtcatgtttaacaaacaattaattaacgctactgtttgttgttgtggatcgcgtcttatgcgacccacagtttggcgtgcttacttttagttgagtaactgctaacgtaatcgggaataaatgcataaggcgcaaattcaagtgagaagttcttgagtttgcgccttttttgtattctaaaggagatagatattatgaaattcaacacacaattaattcatggcggtaatagtgaggatccaaccactggtgctgtctcaacaccgatttaccgttcatcaacattccatcaacacgttcttggcggtgaacctaaatgggaatattctcgaacaggaaatccaacacgtgcatctcttgaaaaattaatcgcagagcttgaacatgggacagccggctttgcatttgcttccggatctgctgctattcatgctactttttctttattctctcaaggcgatcattttgtagttggtagtgatgtatacgggggaacattccggttaatcaataaggtattaaaacgctttggccttgaatttactgttgttgacatgcaagaccttgaagcagtcgaaaatgcaattcaagataataccgttgcagtttattttgaaacaccaactaatccgctcttgcaaatcgctgatattaaagcaattgctgatatcgcaaaaaagcatggaataaagacaattgttgataatacctttgctactccttataaccaacaaccgttaactcttggggcagatattgttgttcactccgcaacaaaatatttaggcggccatagtgatgttgttgccggattagcagttactaacgatgatgaaattgctgaacaattagcattcctgcaaaactcaatcggtagtacgcttggtcctgatgatagttggctactacaacgagggatgaaaactctcggtgcccggatgcgcgttcaccaagaaaatgcgaatgaagttattaacttcctccaaaatgatgaccatattgggaaaatttattatccaggcttaaaagattttcctggtcatgaggttgcggctaagcaaatgcgtaactttggagcaatgatctcctttgaacttaaggatggtttagatgcgaagaagtttgttgaaagtctacaattgattgatcttgccgaaagcttagggggaattgaaagtttgattgaagttccagctgtcatgacccatggatctattccccgggaaataagactagagaacggaattaaagatgagttaattcgtctttcagtgggaatcgaggaccctgaagatattattgctgacttgcaacaagcacttaaaaaattagactaattatagaagaagggaaactgtgacttatgtgggaaattatcaagacatctttaccacaactcttagcagcgggatttaaatatacgattccgttagcgattatttcatttttctttggactgattattgcactagtaacagctttaattcgtctttctcgtcaacgtggtgcattcatgattcttaaatggattgctagtttttatgtctggctttttcggtcaacaccgctgctggttcaattatttattgtattctttggactgccatatctgagaattaagggagtcctgccacatggaataaaattagaaccatttacagccggcattattacattttcacttaataccggtgcttatgcttcagaaacaattcgggcagcgatcagttcagttccaactgggcaatgggaagcgggcgcagcaatcggaatgacgcggttgcaaatcttgtggcgaattattttaccgcaagccttaagagtagctttaccgcctttatcaaacagttttataagtttggtaaaggacacgtcattagctgcttcaattacaattatggaaatgtttgccgtcagtcaacagattgcggccgaaaactatcaaccattactgatgtatactttagtagcaatggtctacgcggtctttacgacagttttatcttatttccaagggtatcttgagcgggtagtagaccgtcaagtaaatgcaaataataggtgagaaaaatgaaattaacaaatattaataaaagttttggtaataaaaatgtcttgaaaaataccacgttagagtttcctgcaggtaaaacaacagtaatggttggtccatctggatctggtaaatcaacaattctccgctcacttaacttattggtaatgccagagagcggccagtacgattttgatgatcatcatttggattttagtcaaaaagtaagtaataaagataagttggcaattcgtcaagaaacagggatggttttccaagactacaatctttttcctaataaaactgtccttggtaacattattgaaggaccaacacaggttttgaaacagacgaaaaaggaagcaattgcaaacgcgcataatttacttgctaaagtgggcttagcagattatggagaagcctatccgaatgaattatctggcggacaggcacagcgggtggcgattgcccgagcattagcaatgtcaccaaagtatatcctacttgatgaaccgacttctgcccttgatccagaattagagcttagtgtgttgaaggttctgttgcaattagctgaagaaaaacaatcaatggtaattgttactcataatatggtctttgcgaaacatgttgcggataagattatttttgtcgagaacggtgaaattttatatgatggtactccagacgagttttttgctccagataatccaaataaacgaattaagaactttatcgcctcaatgacaatggaaaatttaaaataaaggaagtttagaataatgaaattttggaagaaagcactattaacaattgcagccttaacagtcggcacctccgcaggaattacaagcgtttctgccgcttcatcagctgttaattcagaattagttcataagggagaattgacaattggtcttgagggaacgtactctccgtactcttatcgtaaaaataacaaattaactggctttgaagtagatcttggtaaagcagttgctaaaaagatgggcttaaaagctaactttgtaccaactaaatgggattcgctaattgccggtcttggttcaggcaagtttgatgtagtaatgaacaacattacacagacacctgaacgggccaagcaatataatttctctaccccatatatcaagtcccggtttgcattaattgttcctactgatagtaacatcaaaagcttgaaggatattaaaggcaagaagattattgctggtacgggaactaataatgcgaatgtggttaaaaaatataagggtaaccttacaccaaatggcgattttgctagttccttagatatgatcaagcaaggtcgggctgccgggacagttaactcccgtgaagcttggtacgcttacagcaagaagaacagtactaagggtctcaagatgattgatgtttctagtgaacaagatccagctaagatttcagcactttttaacaagaaagatactgctattcaatcttcctacaacaaggcactgaaggaacttcaacaagatggaacagtcaagaagctatctgaaaagtacttcggtgcagatattactgaataattaaaaaagatctccaacgtctgtgtgttacagtgttagagatcttttttgaaagctataaataaaatatatttatcacagctttttcacaaattaatgttaaattattatgctaaagttcccattggatcccaaggcttaagaacgacgggggtcttagcgtaatcacgtttaagatcttcgctaaggtacttcttattaataacgacttggtagcagtacttgtccatccaatcatcactcataacaaagtaacctttatggccgaccttgttaccccatgagttttcgactttccacttggttggcttaccattaacaaggtcaacaccagtgataaccattgcgtgatccatcatgctttcaccataatcaagtgcttcagctttagtcatttcaaggtcaacgtcaaatagcttgtcgtagtcataggtgttaagggccataatcccaagtttagtttctgaatatttaataacatctgaaccaaaccaaacactttcgccattctttaattgttcaatcgcgagttgcttgaattcatccattggcaggtttaagtgcttgatttcgcggccaccaacgacattaccaagcatgtcgatggtgtaagtttggtggtacttcttatcagcagtcggtgcttggataattgagatatagtcatcgaggttccagccaacatacttcttaaagaattcttgaggagtaaggttagtatcgcggtggaattcgttgtccttctttgtccgatattcgaaatcaaagtggctaaccggttcaccaaacgtgtaagcaagcatccggtaattttcattcaacatcttccggcgtgtttcatcgatcgcttcttcatttgcatgatcttcgttaatcattttccgcaaaataacggcatcgtgacgaagcttgttgtttaagacttcatcaattccccgtgagttagaagagttaaatgattcgggcattgcggcttttggcataaccccatacttgctgataagggcgcaaagcatatcccattggccaccatcgttttgtggttcgttcattaaccatgaaacttttcggctgtcggtaggctttttagccgtcttaattacgttttggtagaagtaattggatttttcaaacttatcccagaagaactggtaggcttgggaaagttcaaaattatcaggtaagttaaatttttgctgcatatcatgacgcattgtgtttagtgccgcaaacatccaacaacgaccggattgcttttgatcagcaacatcccccgttttaaggtcaatggagaaatgaggagtattatcagcaattgaatgccaattgaagcttgcattccgtaccccattttttgtaacagtattttctaagacactgctgttagggtgatgacggtagtttttatgaaaactagcgatatcttctttgttaattgaaaagttcatttgcaatatctcctttgaatagattgaattaacgggcgtgtaatacctttggaccttctggagtaccaacaattacgtcgttaactcgatttaagaataaaccagtttcaacaattccaaccatgtggatcaattcgtcggctaaggccttaggatcatcaatttcgccaaggtgaaggtcaatgatatagttattttcatcggtacggaactttttatctccatccatccgccaagttggcttgtaacctttcttttcaagacggtcaaagacatgttgagaaccgaatggaattacttcaacaggaagagggaaagcgccaagtttgtggacgagtttgctttcatcgacaatccacattactttatttgaggcattggcaacgatcttttcccaaaggagggcgccaccgccacctttgataccttggaagtcatcactgatttcatcggccccgtcaatagttaaatcgatgtggtcaacgtcatcaatatctttaattgtaattccgaggtcgcgtgcttgcttagcagttcggtttgaagttgttacaccgataatgtctttgattttaccttcttggacttgcttaccaagttcatcaaccatatatttaacagttgatccagttccgagaccgacaatcattccagatttaatgtacttaactgattccttacctgtttgttcttttaatgcattttgatccattaatattcctcctaattaaagcgatctgcaactggcaatagttgctgatattctggatgtagtttgaattgcgctaccgcatatgggcacatgagcttgacagtgtattgttcttttgttgcataatccacaaattgacgcactagttcagctgcaattccttgtccacggtaagttggttgcacaaaaactcgttcaacgacaacgtgatcatttgtatcaggaacttttggaaaactgatctcgccaactaagggttcttgatcgtcaaaagcaatgatacgctgactatcaactcgatattgcatataaacacatcctttcataataattttcgataaactgcttttaaaagtcaagttatcaaagcgataccattaacttattatctagcatataatagtatactggaattattaagaataaaacactatgaggtgaacgtaatgaaacgtggatttaagattgtttctagtaagaaagaccaagatatacatttaccccaacgccaaacaacgcgggcagccggatatgattttgaggcatcagaagattttgttctgccatcaatttggaaaggcaatttcttaaaggcgctttggcaaattcatcaacaaaaaaagctgactgatgaagagtttaaggctgctgattcctgcttaaagccatacttagtcccaactggcatcaaagcctacatgcaacctgatgaatttctcttattagctaaccggtcaagtggtccttttaaacgccgcctgattttaccaaatggaatcggcattgtggatgcagactattatgataatgatagtaatgaaggtgaaatcttcttccagcttattaactacgggttacgagattatcatataaaaaagggagaacggattggtcaggggatttttatgccatatttaatcgctgatggtgaggaacaaccaactgccaaacggactggcggatttggttcaacaaaagaataaataacttagagaggaattaaagcaatggcaaaagttcgaacacaatatgtttgccaaaactgtggttacaactcaccacgctacttaggccggtgtccaaactgtggtgagtggaatactttagtagaagaacaagtagaagccaattctgcaccaacaaaaaaagcaaccaccaccttaaccggcttagttgccaaaccacagaaaattaatgagattgatagtacagagactccccgcgtaaaaacaaaattgaacgagttaaatcgtgttttaggtgggggaatcgttccaggatcactaattctaattggtggggatcctggaatcgggaaatctaccctccttttacaagtttctggacaattgagcgatgagcatcaccgagttttatatgtgtctggagaagaaagtgggacacaaattaaaatgcgggcggaacggttgaaggttgctggagatgacttttatgtgtatccagaaacgaatatggatagtattcgggatactattcgtgacctcaagccagagtatgtcgttattgactccgtgcaaacgatgcaggcaactgatgtaagttccgcgattgggagtgtatcgcaaattcgtgaagttaccgcccagttaatgcaaattgctaaaagtaataacattacgatttttgttgttggtcatgtgacaaagggtggtgcaatcgctggtccaaagattttagagcacatggttgacacggttttgtattttgaaggagatctgcaccatacatatcgtattttgcgatcagtgaaaaatcgatttggttcaaccaacgagcttggtattttcgagatgcatacaaatgggctgacggaagtaaaaaatccatcagaaatctttttagaggaacgattacatgatgcaactggttcagcggtggttgtttcattagaaggaacgcgaccgattttagtggaaattcaggcgctggtaacaccgaccgtttatggaaatgcacagcgaactgctaccggtttgagtcgaaaccgagtatcattgataatggcagtattagagaaacgtgctaacctaatgcttcaaaatcaagatgcttacttaaaagcagctgggggcgttaagttagatgagccagcgattgatttagcaattgcggtaagtattgcctctagttaccgggataaaggtacccaaccaactgacgcatttgtcggtgaagtaggtttaactggggaaattcgtcgggtaaaccgcattgaacagcgggttgctgaagcagaaaaacttggatttaaacggatctttattcctaaaaataatttaaagggttggaaaccgtcaactaatattcaagtaattggtgtctcaaccctgaaagaagcgttatatttagcgttggggtaaaaataaataattgaaaggatgaagcaaatgcggcgtagaatgattactctcatttatattctagttggcgcggcagtgggattttattatttgccattattatgggggattttgaacatcgcccttaacccggcattattagtatttatcgacattattattggtgcacttattttctggctattatcactcccattggctagcggcactgaaaagttgatccagcgaatcgaaaaagaactaaccaagcgtagtcccgtataccttttctttgggaccttattaacgattattggcttagttttagcagttcttatttcgattccattgtggagaacgaggattccggtaattaataatattttgccgatcctcttgatgattgtctttagttattttggttttcgaattggtacgacgcggttagatgattggcgcaaagcatttacccatgccaaaagtagtaaaaacgatggtgggaatgtaattgaacgccaggatgataattaccatcattataaaatcttagatacgaatattttgattgatgggcgtatttatgatttagtcaaaacaggttttttagaagggacattactggttcctaactttgttttatatgaattgcaatatatcgctgattctggcgaaagtattaagcgtgttcgtggacgccgtggccttgatattttaaataagttacggaatgagaaaattgtcccaatcgaaatgtatgatggggactttgaagatattccagaggttgatagtaaattaattgccctcgctaaaaaagtcgatggggtaattgtgacaaatgattataaccttaataaggtaattcaattccaaaatgttcaagtactgaatattaataacttggcgaaatcattgcggccacgagttatcccgggcgaaacgatgacggttgttgttgtgaaaaaagggactgaacgacaacaaggtgttgcttaccttgatgatggaacgatggtggttgttgaagatggtcgttacttcatggataaacaaattgaagttgaagtaaccagtgcgcttcagacagacgctggtcgaatgatctttgcccgtccgctccattcacaacgaggaattgacgagcatacagaccataaagaaaatcggaacaataaagacaagaaaaaataataaagaatggctgcgaagagagttttcttacttccagctatttttttaaacaaaaaagaagcagctcgggaaaaagctgcttcttagggagtattacgataatcttgggggagatttcgtaaaaaaagaaaatatttttttcggttactattgggaggagtaattgaaaaataataggtttcattgatgtagtaaagttcatctttactacgctatatataataacagtagaatgtgaagaaagtatgaccaaatggtaaataattttttggatacaaattaatatcatcagaaatgctattctaatacggaatgtggtaagattaactgtacaaattaattctttattaatgatttttaaggagcggatagacatgctaacaatttacaatacgttaacaagaaaaaaagaagaatttaagccattgcatccaggcgttgttaacatgtatgtctgtggtccgacggtttataattacattcatattggaaatgcgcgcagtgcgatcgcctttgatacagtccggcgttatcttgaatttaagggatataaagtaaattacgtttcaaactttacggacgttgacgataagatgattaaggcggcggccgagcaagggattaccgttccacaattagcggagaagtatatcaatgcttttatggaagataccgcagcgattaatattgaaccagctactcttcatccccgggcaacagaaaatattacggagatcattaaattcgtgcaaggattaatagagaaaggatatgcttaccctaaagatggggatgtttattatcgggcacgaaagtttaaccactatggccagctttctgggcaatcacttgatgaccttgaagttggggcaagtgaacatgttagtgcggatgaggttaataagaaggaagatccgcttgattttgctttatggaaagcagctaagcccggcgaaattagttgggattcaccatggggaaaaggtcgtccaggatggcatatcgaatgttcagtgatgtctactaagtacttgggaaagacaattgatattcatgcggggggacaagaccttgaattccctcaccatgaaaatgagattgcccaaagtgaagcagaaacgggccaaaaatttgttcgttactggatgcataatggcttcgtaacaattggaaaagacaacgagaagatgagtaagtctctccataatttcattactgttcatgaaattatcaaggaagtagatcctcaggttttacgtttctttatggcgactacgcaatatcggcgtccaattcaatatagccaggcaaacctaactgatgcgcaaaataatcttaatcacattcaaacagcctttgataacttgacttatcgtgaacaagatgccgatgagggagatgttcaagaagtcactgatcggcttgagcaattccatcaccaatttattacagcaatggatgatgacatcaatgttcaaaacgggattgccacagtctacgaattagttaaatatgcaaatgtttatgctcaacaagataatgttagcttaggtgccattcaagcaatcaaaaaagagcttgttgaattgatgagtatttttggcgttaagcttgaagcaagtgacaatcaaatcaatgatgaaaagattaagcaattgattgaagaacgaaatatagcacggaagaataaagattttgcgcgaagtgatgaaattcgagacaatcttaaaaaacaagggattattcttgaagatactcctcaaggaacgcgttacaaaaaggaatagaaaggatccttatggtacaagcagactatcgacaacttaatggaattgctttggcttatttaggggatgcagcttatgaggtttacattcgtcagcatcttttaaccaagggaattagcaaaccaacgaaattgcagcatattgctacccactatgtttcagcaaaagcacaggcggctctcattgacctgatgaaagaagacaagttattgtcagatgaagaatggtcgtatttcaaacgtggccgaaatgctaatagtcatacccatgctaaaaatacatcagtcatgacttatcggatttccaccggatttgaagcggtgatgggttaccttaaattagctgggaaagaagagcggttggccgaattggcgcaatggtgtattaaacaagtagaagcggggcgaacagcgcatgaaaaatgagaatacagattttattattggtcggcatccggctgtgatggcactaaaatctgaccaagaaattaataaggtttttattcagtcggggttaaaggccgatgctatttcccagattgttaaactagcaaaggaacgtcacttagtagtgtcaaatgttcctaagaataaattggacttgatgactgaccggcaaaatcaccagggggttgttttagctgtagctgcctaccaatatgcaactattgatgacctctttgataatgcagctaagcatgacgaagatccatttttccttattcttgatgaactagaggatccgcataatttgggttcaatcatgcgaacagctgatgccgctggtgttcatggtattattattccacgccggcgagcagtaggattgacttcagtggttgccaaaacatccacgggagcaattgaacacgttccagttgcccgagtaacaaacctggttcaaaccgcgaaagaattgcaggaacgaggcgtttggctattcggtactgatatgaaaggaaaagattaccgaacatgggatgcgcatggtgccgtcgctttggttatcggcaatgaaggtaaaggaatttcatccttgctaaagaaaacttgtgatgaaatgctgacaattccaatggttgggcatgttcaaagtttaaatgcgagtgtggcggcaagtttattgatctaccaaggcttcaactctcgtcatcctttaaaataattttgattttattgcttttaaaccttgattcgtgctaacctaagtactgtgtggaggtgataagtatgtcccagaaaaaagtagcattggaatgtacaaagtgcggtgcgcgtaattatacgattaccgctaaccctcaacgacaagaacgattagaattacgtaagttctgtaaacattgcggtgaatatactattcatcgtgaaagcagatagtggaggaaaatatgcacttaattcgatttattaagagtgttaaccacgaaatgaagctagttgtatggccaacagctaaagagaatcgtcgtgatacgactattgttgtttcattgactctgttcttcgtactattctttgctctgtttgattggttaattcaattaatgatgaaactctttgtttaacattagtagtcaaatagaaattagtttgttatactaagtctaagggaacttcgtagctattacgaagttttttattttactgaaaaaaatgatttgaattatgataggaggattcatcgtggaatcacatgaaaaacgttggtatgtgctccatacctactctggttacgaaaaccgggttaagagcaacttggaatcacgggctcaatcaatgggaatggaagactacatttttcgcgtagttgttcctgaagaagaagttcgccaggttaaggacggtcaagcaaaagaaacaattgaaaagacattcccaggctatgttttagttgaaatggtaatgactgatcaggcttggtacattgctcgtaatactcccggcgtaactggtttcttaggatctcacggtggtggttccaagccaaccccattgcttcctgaagaagttgatcggattatgaaacggatgggaactgaaacaactgttagtgacattgatgttaaggaaggcgatactgtaaaagttattgcaggatcctttgcaaatatgactgccaaggttgtagaagttgatcacgaaaagcaaaagattaaggcgaccgttgaaatgttcggccgtgaaactgctgctgaattaggctttgatcagatcgatacattttagttagtttaatattttgaaaattgttgaaataagtttagaattgtggtatgttttctaagtatgctattaacatactgtgggagaggtaaaacttactgcctcatcatgaccacaacacggactaaggaggttttgtctcgtggcaaagaaagtagctaacattgtcaagttgcaaattcctgccggtgccgctacaccagctccaccagtaggtcctgcacttggacaagcaggtattaacattatgggcttcactaaggaattcaacgcacggactgcagaccaaaagggtatgttgatcccagttgtaattactgtatatgaggaccgttcattcgacttcattactaagacgccacctgctgctgtcttactaaagaaggccgctggtgttgaacatggttccggtgaacctaacacaaacaaggttgcttcagtaacgaaggaccaagttaaggaaatcgctgaaactaagatgcaagatctaaacgcagctgacgtagaagcagctatgcgcatgattgaaggtactgctcgtagcatgggcttcactgttgaagactaattactagcagtcgggatgcgctatgaaaatagtgcacccacgtgggaggtataactccgttagaccacatttgcaaggaggaaaacacaagatggctaaaaaacgtggtaagaagtaccaagacgcgctcaagaaagttgacagcaagaaagaatacgctgttaaagacgctgtccaattagtaaaagatattgcctacgctaacttcgactctactatcgaagtagcatttaacttaaacgttgatacaaagcaagctgaccaacaattacgtggtgccgttgttttaccaaacggtactggtaaggatcaaacagttattgttttcgctaatggtgaaaatgctaaggctgctcaagaagctggtgctgactttgttggcgacgatgatttagtagaaaagattcaagacggttggcttgactttgatgttgcaatcgcaacaccagacatgatgcctaaggtaggtcgtttaggacgtgtccttggacctaagggcttaatgccaaaccctaagactggtactgttacaatggacgtagctaaggctgtttctgatgccaaagctggtcaagtaacttaccggactgaccgtgatggtaacgttgctgtaccattcggtaaggtttcatttgatactgacaagttagttgaaaacttggctactttagaagatattgtggctaaggctcgtccagcttcagtacgtggaacatacatcaagcacgcttccatttcttcaacatttggaccaagtgttacgcttgatttaactacattttaatttgaattaattaaaattaacaagactttgagacttttttgctcaaagtctttttttatcttaatttttacttcacaatagggattccttgtgctatattattaaccaatgataaaacgattaaaaaataattagagtttatcatttaagtttaaaactaattaaggagtgacgacaatgacacaatttaaatattcaaagcgtgttccagcagatggtacggatgcggttggtgcaattttacaagcagcggcggatcctaagattatttcatttgctgggggattgccggcacccgaattgtttcctgttaaagaaatgaaagcagctgttgataaggtttttgaagaacacggtcaagaagcgatgcagtacggagcggcgaagggagtcacagctttacgtgaagttatccaacaacatgtaaaggaaaaagaaaatgtggattccgaattagacaatgttttagtaacaacgggatcagaacaagccttagatttagtgggcaaggcttttgttgacccgggtgatactgtattagttgaacaaccaacgtacctgtgtgctttagatgtttttcgttcttacggtgctaattttgctagtgttgagatggatgaagatgggatgaagatggatgctttagaagaagcactaaaggctaatccaaatactaagctcatctatactgtgccaaacttccaaaatccaactggacgaacaatgactgaagaacgacgaaagcagttagctgaattagcagaaaaatacgatgtatatgtactagaagataatccatatggtgaaattcgttttgctggccaacatgtaccagcagttaagtcatttgataaatcaggccatgtcttttacatgagtacattttcaaagacgttagccccaggatttcgtttaggatggttggttgctgataaagctgtagttaataaattaacggttcttaagcaatcagctgacctccatacagataacttagctcaattcgcggttgcccaattctttgctgataacgatgtggatgctcacgttaaagaaattagtgctttatacggcaaacgtaaagatttgatgcttgagggaattaaaaaatatttcccagaaggagttaaatatacggatcctgaaggtggcatgttcttgtgggtagaagttcctggtgttgatgatacagtagagttatttaaggaatgtcttgaacatgatgtagcctttgttccaggtgatccgttctttgctggtgaagttcaacctggtgctttccgtttgaactattcaaatatgaaagaagaccagattgaagttggtttgaaacgtttaggagcggctttaacagctgcagttaataagtaattatttcagccattaataaatacaatcctaataaaattaaatgatgatgggagtaagacagaagaactcccgtaagcaataataggcctccaacgttcggttttaccgggcgctggaggcctattataatgcgctgttgacgtaacctgtatctgttcctgttttttattttctgaaatccactgcgttaataaactccctctgtactttgagttaattgtgattataattatattaattgcggaaaagttttaaatattcgggtttctggctatctaattgggatagtaataagcattatcaaaaatttttaagggaaaaggagtttttgataatgtcaatgatagatttcaataatacagaaatggcagtagccgttatctttactttaataataatgtttgtaatatcctttgcagttagttttttattttggctgatttatcaccaaaatatgaaaaagggataattctcgatgctaatcataatttttacgcttatttgggggatcgcgctgtttatatttttggtttattcattgattagtctgctatttcggatgatttcgtatcctcgggacttttatcactttgcaggaaaccagcaaccagctaaaattgatcgtaatttacaatattatgttattgttccctgttttaatgaagcagcagttattcaacgaacaatcaaatgtttgttgcgatttaagcaatttgaaatagtggtagtagacgatgctagtagtgacgattcagttagtcagattaagcagattactaactcacgggtccaccttttgcgacggtatcttcctaatgctcatacaggcaagggggatgtcttgaattttgccctagattatatttgtcagatcactatccgtcagcgagttccctttgaaaaggttattattggcgtagtggatgcggatgctcaattagctgataatgctctgcagcgattaaatgcctatttttcctcgccaaggacgaatgttactcagatgcgagttaaaatgtatccacattttaaaaattggctgcagattttacaagatattgagttttttagtattaatcatatggctcagatcatgcgaatgtatactaaaacagttggtttaagtgggaatggccagttcttccggcttgcaccaattattgataaaattggcgcacatccatggggcaatgcgctcttagatgattacgaactaacgataaaaatgatgctgaaaaaattgcatgttgattatatgacagatacatatgtttatcaggaagcgttaacgtcccctaaaagatttgttcgacaacgaagccggtgggtgcaaggcgatttaaattgtcttaagtatcttccacaaattattaaaagccgagttttaagcaggacagagaaacttggcatatattatttcctgcttcaaccatggctcaattttctggcggatgttgcaattattattttaacgacgattacccttactcactggcataatctttatggtcacttgactcttatgactttttcattagtgatggctggcttggtagtcttttcgttattttggggaataatatttgggatattttactatcgggacttagcccactaccatgaaccacctttaaaaaagcatcaattagccttattaccgcttggaatttcctatatgtatgttatcttattttttagtattataatggcttattggcggtggagttttcgccaaaattcgtggataaaaacggaacatggaaaaatgtttcttaagtagcggggagatatgatgagaaagattaaagtaatgacggtatttggaactcgtccagagggaatcaaaatgggcccagtagtcaaggccttggagaaagatgatcgcttttcatcagtagttgtttcgaccggtcagcatgctgaaatgcttcaacaggttttagctgtttttcagataacccctgattatgatttgaaaataatgcgtcctggacaaacactaacggaaattacaattgaaacgatgacaaagcttgaaccgattattcaaaaagagcaaccagatattgtgctagttcatggcgatactagttcagcctacgcatcagctttggttgccttttataatcgggttgctattggtcatgtcgaagctggtttgcgaacatggaataaatattcgccttatccagaagagatgaaccggcaaatgattgatgatcttgctgatttatattttgctcccacccaaacaagtgctaacaatctcaaaatgggaaatcatcagcatgggattatagtgacgggaaatactgccatcgatgctttgcggtatacaattgaccattcgtatcatcaccaagtattagacgaaattgatcccgacaagaaggttattttacttaccatgcatcggcgagaaaattggggtaaaccgatggaagaaacctttaaggcgattcaagagattgtggatcaacggaatgatattgacgttatttatccggttcatctgaatcctaaagttcaagcgattgctaataaaatttttggaaacgataatcattttcatttgatttccccattagatgttgttgattttcataatattatgagtaagtctttacttgtgatgagtgattcgggtggggttcaagaggaagcaccagcacttcataaaccagttttagttttgcgtgatactacagagcggccggaaggagtaactgctggaactcttaagttaatcggtacgcaatttaataacgtaacgaaagagttatcgtcactattaaatagtcctgaagaatataataagatgagtgaggcacagaatccttatggggatgggcatgcaagtgaacgaattttagatgctattgctagatgggtagcaactcaaaaagaattataaaaagtccctttacagaacttcagagaatatgttaaactgtaacagttgattaaatatgactctgcctaagactcaggtggcgaaagccttaatcgaatgcctgccgaggaagaaatgaaagttccttctctatgtctgcggtcatagggatttttttataaatccgatcaaaaaaacattgcaggaggtgaaaattcatgagtgaagcagctattgctaagaaagctgaaattgttaagcaaactactgatatgcttaatgcagctcaaagtgctatcgttgtagattaccgtggtttaactgttgcggaagttactgacttacgtaagcaacttcgtgatgctggtatccaaatgtcagttatcaagaacaagattcttgatcgtgctgttgaaggtactgactacgaagatcttcgttctacttttgttggaccaactgctgttgccttctctgacgaagacccaattgctccagctaagatcttgaagaagttcgctgatgaccacgacgctcttgaaatcaagggtggtttcatcgaaaagagtgttaagactcttgacgaaatcaacgaatacgcaaatatgccaggtcgcgaagaactgttgtcaatgcttgcatctgcattgcaagatccaatgcggaagattgctcgcgcagtcaaggctattgccgacaaggaagacgaagccgcataattgccgtatatcaatacaatataaaattaaaattaattacctaaatattggaggaaataaacatggcttttgataaggatgctatcattgcttcattaaaggaagcatcaatctctgaccttaacgacttagttaaggctatcgaagaagaattcgacgtttctgctgctgctccagttgcagttgcaggtgctgctggtggcgacgctgctgctaaggacagcttcactgtagaattaactgaaccaggttcagctaaggttaaggttattaaggctgttaaggacattactggtcttggtcttaaggacgctaaggaccttgttgatggtgctccatcagctatcaaggaagacgttaaggaagacgaagctaacgacatcaaggaaaagcttgaagccgctggtgctactgttacccttaagtagtcttaagttattaaataaaaaagagttacgagaagcaatttttcgtaactcttttttatttcggggataccatatgaggtgttcctttataatacgaaaatagctcctaccatttattctaaataaggagctattttatgatgtgtgcaaaattttagaagaacaggaaagttaaaagtaaataagtctactttgcaggatgagtagtactatcgttgcttgtgcggtaaccaaagtagaattgaatagcggcgatcgcaatgttaacccagttcatagcaataaaccaaccgttaattgcgcttgcatcatgagatacaccataataaacccaaaaaccgataacaattgcacaaacattgatccaagcgaaagtcttttgtagaatttgattattaagctggaaccacatccaaatgacattaatgacaaaccaaatagctaagatccaaaaaataacattaaataacataagatatccctccttagggcctcgataaacattaataaacgcgtattgaactgatgaatagcaacattcgaaaaaagtattacgcggtgtggttagcagttgaagttatttacaatgattggtaatactttactattttttggaaagttgttgcttagcatcttcatacccgtcaacatagtcacgaagagcatgcatcttacctttaataaacttattggtaacattaataatgcgttgtggatacttccggaagggttccagtgccttataatccttaacggcctgatcataacctttttggtatgcgtttgttgcatctttttggctatttgacgtaggacaatttttctttttaaacataattatcacctcttttgttttcctaccatgatagtaacaagtatataaattcaattccaataatatggtataaaaataaaaatgttatacaataataaaaatgctgattaaaaacttttaaccagcatttttattattctttattctttttcagaagttcagtaatttctttaaggtacataacttcttcacttggagcttctgtttttttatcttcttttttgcggaatgtattgattgcttttaccattaagaaaacaacaaaggagataatcaggaagttaatgactgcatttaggaaacttccgtatttaaactgagcatcgccgaccgtcaaaacaaggttagataggtcaattcgaccaatgaataaaccaataagggggttaataaggttattaactaaggactttacgattgaggtaaaagctgcaccaacaattatcccaactgccatgtcaataacgttaccgcgggcaataaatgtcttgaattcttttaacataaaataggcctccttctagctttagaggggaacaacttcaattatgattatatcaaacagaattatatgcttagggcttttatgagatgacataaggagatttaatttatttttaaataataattgcatattatatcaaaccattatattatatgacatataatattacagctaaaaaggagggatagaatgaagattcaaattacagctgacttactcgatgggatggttttagcaattcttgaacacaaagattactatggatatgctttaacccagcgaatgcaatcagctattaccatttccgaatcaacaatgtatcccgttttacgccggttaaaaaaagacggttatttaataacttatgatcagccttaccagggacggaatcgccgttattatcaaattacgaaagccggtaaggagcatttacaacgtattcgtaagttatggactgattataaaaatagtttagatggtattttttatgggttaggtgagggagaagataaagatgaatgaacgtcaaaaatacattaatgatttatcaatatatttaagacaattaactgatgaagaacgaaatgatgccttagaattttatgatgaatatattgccgacgctggactggagacccgaacagcgattgaagaaaggctaggaacgccacgacagttaagtcataagatattagctgattattcaattaaagctaataatgaatcgatcaaagaaggacatcctgcttcgcctcattctagttggcgtgtcttttggtgggtgctagtggcaattattacttccccaataacgtttggactaggaattgccgtattagcactattgttggcagcagggggagtcgccttaagtttgattgttggaatagttgctttgatcttcggagttgccgttatagcaattgtgtccctttatattggaattggtttacttgcgacaaacttgttcagtggactattttatcttggattaggagtgaccctcattggcttattccttgtttgtttgcctttaatctactggttaatcagagttattgttcaagggattgccaactttgctaagttcatttatgcaaaagtgcaggcaaggaggaaaaagtaaatgaaaagaatatttaagataggagtaattgttttaatcttaggagtaatcctcctcggaataggcttctttaataatggtaataaggccatttattttgagaacaatcgtccagcaatctttcattctcacactaaaacaataagtactaataaagcttttgaacggattgatatctcagcatcgacggctaatgtaatagttcgtgaaggcaagaaatatcagattacttattctggcataagcaggcatactccagctgtaactgttcataataacgttgcttcaattcgccaaactggtggctttccgcttgtctttaactttaatgattatcagccccaccaagatttaatcattgtgactatcccacatgatcaagccttagctggtcgtattcatttagagagtggtgatctaacagtttctaaagttaaaatggacaatattgatgttaacagtgacgcaggcgaggttgaataccgtcaagttacattacgcggaggaagtacaaaactctcgtcaggtaacttcacaggacatgatttaacagttcagggacaatatactgttaataatcaatctggtgataatacagtcacaagtacaacagttgatgggtatttcctgaaaactgaagatggtgataatgagcttaatggtgaagataaaggtgaagaacccttgcatcaaaatgatgatgcagaaaatgtactccgcttaataacacaatctggtgataatgaagtaaattgatttagctgaaattaataaaaggccctcgacagatatcgagggcctttttaataggagaaaagtcttaatttttaattatgcgctggattatttttcttcaacgccagtaccatcgtagcaacgttcaagtaattccttgagttggctaacaagtggttcaactgggttagtagtagtacattgatcttcgtaagctaagcgagcaagatcgtcaaccgccttatcaaattcttcacgtgtaacaccattgtccttaagactaagcttaacaccacattcgtgagcaagttcgataactttcttagcatatgcttcagctaattcttcatcagtgttgcctttcaaaccaatgaaccgtgcaatgtcagcgtagtccttagttgcatggtaagtctcatagtgaggccagagagcaagcttttgtggacgttttgcgttaaagcgaattacttgtggcattgcaatagcgataagcaaaccgtgaggaagaccgaatgctccacccatcttgtgggcaagggagtggttaattcctaagaaggcttgaccaaatgccatcccggccattgttgagaagtcgtgcatcttacgacgagctaacttatcaccttgaactgacttaggaaggttttccataacacccttgatggtttgtagtgaccaaccacgagtgtagtcagttgccataacagaaacatatgattcagtagcgtgacataaaacatctagtccagtccaagcagtagtttttgctggaacagtttcaacgaattgtgagtcaacgattgcaatgtttggtgttaaggcgtagtcagcaagtgggtacttaacatgagtttttgaatcggtaataaccgcaaatggagtaacttctgaaccagtacctgatgtagtagggataccaataagttgagacttagtaggcttcttgatttggtaagcacgcttccgaatatcaaggtacttttgcataaccccataccatgaagtttctgggtgctcatagaacatccacatagccttagcagcatccattggtgaaccaccaccaagagcaataattgtatcaggtttgaagtcattcatcatggcaacacctttttcaacagtgtttgttgatggatcttcttcaacgtcatcaaatactaagaaagcagtgttgttttggcgttgacgcaattgatcgataacacgttgaacgtaaccacgcttgctcattccaggaccagtaacgatgaatgcccggttaatgtttggaatatcttgcaattcttttagtgagttgcgttgaaagtatacttttgggggaatcttaacccattgacggttttcacgccgctttgcaattgttttgatgtttaagaggtcccaatcagtaacgttgtgagaaattgagttactaccgtatgaaccagtacctaaagtaagggatggagtcatgttgttgtagatgttaccaataccaccaataccagatggggagttaacaatgatccgtgaagcacgcatttcaagaccgtacttagtagctaaatcatcatcaagggtgtgaatagcagcagtgtgaccttcaccaccgtagtgtaataattgagcacagatatcaaaggcattttcgtgagaggttgccttgtacattgttaatactggtgaaagcttttcagctgaaagtgggtacttgtcaccaacaccttcgtattcagcaatgataaccttagtgttgtcaggtactttaataccacacatgtcagcaatagcattagctgaacgaccagcgattggaccacgaacttgatgacgatctgggtcaataaagccatcagtaaatttatcaatttcgtttggcttcaagaagtaacagttccacttttggaattcttctttaaccttgtcgtagatttcttcatcaacaacaactgagttttcagtggcacaaatcataccgttatcgaatgtcttagaaagaacgatgtcgtaaacagaacgttcgatgttggcagttttttcgatgtaagcaggaccgttaccaggaccaacaccaagagcagggttaccagaactgtaggcagccttaactaatgaaggaccaccggttgctaaaatagtagcagtattagggtgttggagtaatgcggtagtgttttcgcgggtactttcagggagccattgaatcatgttctttggcgcaccggctttttcagcagcttcttggagaatctttgcagtcttgatagatgacttcattgcttgacggtggaaagaaaagatgattgtattccgtgtcttagcactaatgattgatttgaagatcgttgttgaagtagggttagtaactggaacaattccggcaatgacaccaagtggatcagcaattttgatagtttggtcttcatcattgtcttcgataataccaacagtcttatcgtgacggatgttgttccaaatgtattcacttgcgtagatgttcttgatagccttatcttcagcaaccccacgaccagtttcgttagcagcatcaacagctaagtccatgtggtgttcttcggcagcgagagccattgcctgacaaatcttgtcaacttgttcttgtgaatagtaacgtaacttttcaaaagcagcttgactcttagtcattaaatcgtcaactagcttttgggcgttttgctttttttcttcagcagttaattctttcttttcaacttgtttcttgttgttagcaggcataattgaaatctcctttttcaattcttttctttgttaacctttgaacatgtataatgttactacatttttttgctttgtaaatacctttgtgaacatttaaacaatggttgttttgtatgaattcgcttacaatattgtctttataatacttttatagcagcaaaaaacattggtattatttttgagattaagagatgatagatttgcatactgttattaattgaagtctatttcacaaatagaatataaaagcgaatatattaatttaactcggctagttattaagttaactaatcattaacagattattattgggaataataaaaaagccaccattcagaaatggtagcttttttattaatcgcaggcattaatgtcttttcccgcgtttggatctttaacgtcataatcactatcattcattgcttcaacggcacccatgcgatatccattgccgacttggctaaaaaaatcgtggttagaagtagaagtagaaattccgttcataacaactgggttaacatcagaagcggtatcagggaatagtggatcttgaccaaggttcatcaatgccttattagcgttgtaacggatgaaggttaaaacatcatctgtccaaccaacttgatcataaagaagatgagtgtatttttcttcattatcatataattcataaaggaaattatacatccaatctttcatatcttgttgttgcttttccgttcgatcacgtaagccgacttggaacttgtatccaatgtatgtcccgtgaactgattcgtcccgtaaaattagcttaatgatttcagccacattgtttaatttgttgtgaccaagataataaaggggagtgtagaaaccagagtagaataagaaagtttcaagaaaaacgttggctactttctttttgagtgggtcttgacttggatcaaggtacatatttgcaattttgacagccttgttttgcaagtattcttctgtatcggaccattcaaagatttctttgatttggtctggggtattaagagtagagaaaatagttgagtaactcttagcatgaactgattccataaattggatgttattaagaactgctgtttcatgaggagttttaacatcttctttaagggcagttaatcctgcttctgattgaacagtatcaagaagggttaaaccaccaaaaacatgtccgacagtccattgatgatcgtcatctaattcacgccaatcatccatatcattggcaacaggaattcgtgtatcaagccagaactgttctgttagcttttcccaggtagctttatcgatcatgtcggaaacttcattccaattgattgctttatattgatttacaggtttaaattcttccagtttcattgattgagctcctccaaatacgttgcttttaataaatcgagataccaaaagccatttgtatacataatatcaagtttaccagtgcccaacgtttaaatcaaattctgattaggcttagataacacagctttcacattggtttgcaccaatttcatcgctatcgtcagtaaacgttcgaatgtagtaaattgacttaataccgcgtttataggcatagtgccgtaagatatttaaatcacgagtcgtcattttatctgttcgtccatttttccattcgtaaaggcctgctgggattgttgaccgcataaagagggtcattgaaagagattgatcgatgtgctgttgtgcagcggcgtaagtgtcaataacctttcgcatatccatatcgtaagctgaacgatagtaaggcatcgtgtcgtttgaaagatatggggcagggtaataaattttaccgatcatcttttcttggcgctcttcaacacgattaatgattggatgtagactagcagtcgaatcgttaatgtaggaagttgaaccgtttggcgctacagcaagacggtattgattgtaaagaccatcttgcattacattttctttcaacttcttccaatcttcaattccagggataaaaataccttcaaaaagacctttaacaacatctgattgtggtccccaatccttagtgacatatttgtcaaagtaggaaccatccgcatatttactgttctcaaaatcgtggaaagtttcctgccgctctttggcaatttcatttgatgccactaatgaccaataatttaagagcataaagtaaacacctgtgaattcaatcgcaaccgggcttccgtattgaatatggtgcttagcgaggtagctatgcaatcccattgcacccaaaccaactgaatgggcaagccgatttccgttttgaatagttgggacaacatctaggtcttctacgtcactgattcgggttaatccccgcatcattgccttaatcgatttaccaaagtcagggctttccatcatattagcaatattggttgacccaagattacaactgatatcaattcccatttcagaatatgattgatcatcatttacttgcgctggtacttgtacttgagcaatctctgaacataaattactcatcacaatttttccattaatcggattatctcgattttctgtatcaatgttgataatgtaaggatagcctgattcttgttggagtttgctgatttcatcttctaagtcacgggcattaactttcttcttgcgaatatcatcgtttgctactaaattgttgtattcttttgtgatatcgacgtaggagaatggcattccgtatactcgttcaacatcatagggactaaacaagtacatatcagcattttgctctactaattcgtaaaacttatcaggaaccgtaattccgagagagagggtctttaagcgaatcttttcatcagcgttttccttttttgctcctaagaattcaataatatcaggatggaaaacactaaggtaaacgactccagctccctgtcgctgtcccagttgattggagtaggaaaaactatcttctaacaacttcattacaggaacaactccactagcagcaccttgtattttcttgattggggcaccagcttcacgaaggttgcttaaattaattccaacaccaccaccaattttagaaagttggagggcagaattgattgttcgaccaatggtattcatgtcgtccgttgtttgaatcgcaaagcaagaaacaaattctccccggcgtttacgcccaacgttaaggaatgttggagttgcgggttgataacgttgatggatgatttcatcagcgagctgcattgctaactcttcatcaccattagcgaggtaaagagcattcattgcgacccgatcaatatagttttcaaggtagtactctttatcatttgtccgtaaggcatattgggcatagaacttgtaagcagccataaaagaatggaagtggaagttttgtgcttttaaataatcgtaaagcttttcaatgaacgcttcactatatttattcataaaagtttcttcaatataatcattttcttctaaccattgaaaacgctcttttaatgaagaaaatcttttggtatttggctcaacattatttttgataaagtcttctaaggccaatttatctttatctagttgaatttgtccgtttttagggatatttacttcgttgttataatcgtaatatttaactttggtcatatcgatatcagataacgccatattaataactcactttctgaattaatttgattatgtcaataaagaagccagtacaccaatagcgaattgatgcctggcaaaatattagtttatttaaacttaggcaagttggtttaattgatcaggacgaaagccagaaaaagcttgaccgttaggaagctttacaactggagtcgccataaaaccctccgacttaagttgcgatatgtattctggttgttcatcgatgttgtgttcaataaatgaaattttgtgctgttcaaggaaacgttttgtcatcttgcattggatacaattattttttgaaaatacagttaccatcttcacgaggcctcctaaacgattagtcgatgttttctagtataacggtgaatcagaaaaaatcaattaaaaaagcactatatttcgtgcttgcgaaatagtgaaacacaatatatagtacttgaactggcgattgacatctgtgaaactttttttgataaaatgcctaagcaggtgatgaataaaattaatttgaaaaaccagtctattattatacacttaaaagcagggtaattttaagtacttggagaaaaagaatgaaaaaaaacaattcatcattatctgaacaacaaaagtttatgaagatggcgattgcagaagcaaaacaagccagaattttagatgaagtaccaattggtgcgattgttgtccacgatggacaggtaattggacgtggtcataatatgcgtgaaaagtttcaagatgttacctatcacgcagaaatgcttgcaattatggaagcatgcacgaatttagggagttggcgcttagaagattgcgacttgtatgttacgttagaaccgtgcatcatgtgtagcggtgccattatcaatgcacggataaaaaatgtttattatggtgccgctgatccgaaagcaggggcagttgatagcttatatcatttactaagtgattcacgtttaaatcatcaagtcaatgttcattctggtattttaggggatgagtgtagccaaatgttaaaaaactttttccgtgaaattcgccgtcgtcggaaagaggctcgaagaaaaaataagactaacctctagtaatttaaagaaaaatagtgtattatactatttgccgtaaggccttagagcaagggcatgcttacgaaccgtgtcaggtctggaaggaagcagcactaagtatgatatgccttgtgctctaagttttattgataattaagcggactcgtaataatttgttgcgggtcttttttattttgaaattttaattaaaatgtattttaactactttatatgcttaattccttgtataatattttatagtattttaaattcagaaagggagtctggcgatgagttatcaggcattatatcgtgtctggcgaccacagcgattcgatgatcttgtcggtcaacagattgttacaagaaccctaaaaaacgccattatcactcaccagataagccatgcatacttgttcgctggtccacgtggtactggtaaaacctcagcagcgaagatttttgctaaagcggttaattgtcatcactctaaggatggcgaaccatgtaatgagtgtgagatttgtaaagcaattacgaacgggcaattaaatgatgtaattgaaatcgatgcggcttctaataatggggttgaagagattcgtgatattcgggataaggcaaaatatgcccctacccaagcggattacaaggtctatataattgatgaagttcacatgctttcaacaggggcctttaatgcattgctaaaaacgcttgaagaaccaccagccaatgtgatttttattctcgcaactacggaaccccataaaattcctttaacaattatttcgcgagttcaacgatttgattttcgacgaatttcagcagaagatgcatttaatcgaatgaaatatatccttgatcaaaagaaagttacttatgatgaaaaagcattatgggtaattgcgaatgccgctgaaggaggaatgcgggatgcgttgagtattcttgaccaggtgctttctttcagtgataatgaagtaaagttggatgatgctttattagttacaggaagtgttactaaacagttattaaagaagtactttttggaaattagtaagcatgaaggggcgactgctcttgatactatgaaggatattttagatgaagggaaagacggtcagcggttcattgaggacttgatttcctttattcgtgatattctgttgtaccaagaatcaccaagcttgattagtgttgaaagtacaggtctaaagcaggaagactttgaagaaatagtccaacttgcttcttcagcgaccttataccgaatgatcgatgaactaaataatattcaagaagagatgcgttttacgacccatccagatgtgtatttggaagttcttacaataaaacttgcacaaatcgaaccacaaaagaatcttcaatcggcaccagcagtttctgcggatacaaatgctgaagctactaagacgattgaaaaattacaacaagagattcagcaattgcaacaaacagtaaaacagttgcagaatacgccggtaagagctagtcgaccatcacctcgccaacaaaatgagcagccacgagtacaacaaaagaaagtgcaggttaatctcaataagatttacccagtgttagaaaatgcgactcgtcaagatttaataaatgttcgtgagctatggggagatatgttgaacctattgtcggtgccgcaacggtcattacttcacgtttcacaaccggttgccgctagtgccgcgggaataattgttgcttttgattatccgttcttattccaacaagcagctgatgatacaacgttgttagagaatatggaaagtgctttgcaacgtttaactgggaatgaacggcaagttgtttttgtacctaaggataagtggccaaaaattcggcaagactttatcaaggatcatggttttggtaagaatcagcaaaagtcgcaacctattacacaaaagccgcaaactactgaagaaagcggacaaactcctgcagctacaccagcaccgatggaggaaccaccgctacccccagaagatgaggcactaactgaagaaaagtcacctcaagaagataaacaagtagcaacagcacagaagctatttggtagtgatattgttaaagtagaagataattaagaaaaaggatggatgatattatgatgcgtggaatgaatatgcaacaaatgatgaagcaagctaaggcaatgcaaaagaaaatgatggctgaacatgaagaacttgctaaacaggaatttgttggaaaagcaccagatgatatggtaactgctacgtttagcggggataatcaattaattgacttaaagattaagccagaagcagttgatccagatgatattgatatgcttcaggacttggtaattgctgctgtgaaagacggaatgaagcaagttaatgatgctactcaacaaaagcttggtaaatatacacaaggtatggggttgtaaaaagtgatccaatatccagaaccattagcgaaattaattgaaagctatactaagttgccaggaatcgggcaaaagactgcaacgcggctggcgttctatactctgagtatgcaagaagatgatgtgacaaactttgctaaatcccttctgtctgctaaaagggaccttcataactgtagtatttgtggcaatattaccgaagacgacccttgtccaatttgtcgcgataagacccgtgatcattcgcaaattctagttgttgagcagtcacaagacgttatggcaatggaacggatgcatgaataccatggtttataccatgtccttcatggagttatttctccagttgcaggaacaggcccagaagatattaatattacaagtttacttaaacgactaaagaaagatgatgaagtaaaggaaattattattgcaacgaatgcttcatctgatggtgagttgacggccggttacctcgctaagttaattaagcctgcgggaattaaagttactcggttggcgcatgggttatcagttggcgctgatattgactatgctgatgagatgacattattcaaagcagtgcaagggcgaacggagatgtaagaaaatgttttttaagcggccgactaaagaggtagaacgtgaacgaaaccaacgtctgctagaagcggtatactctacgaaggctagttgggatcatgcacgtgaaactgaacgggcagtatatgaagcaaacgttaatagtgaacttcattatcgttcccggattcaagagcagaaatttttatacctatataaaattgctcgcaaatttaaagttcacgggaaattaaatgatggagtaattgatcgctaggagagagaaatggacggtaaatttatatcatttgaaggaccagatggcgcgggtaagacaagtgtaatccaacagatccaactggaattggaagatcagcttggcacagaaaaagttatgtatactcgtgaacctggtggtaataagatctctgagcaaattcgccaggtactgtttgatggtcaaaataccgatatggatgggcggacagaagcattgctttttgctgctgctcgtcggcaacacattgtttcagaaataattccggggctgaaagcaggcaaagttattctgtgtgatcgatttgtagatagttccattgcttatcagggagctggtcggggccttggagaaaaagaaatttggcaaattaatcagtttgcgattgatgggctaatgccggcgttgacaatttatcttgatattgaatcagaaattggcttaaaacggattgctgagcatcgttccaatcaagttaatcgattagatgaagaaaaacttgaatttcatcgaactgttcgtcaatcttatttaaaactctaccagaattatccagaacgaatagagttgattgatgcaagccagccattggaaaaagtgattgaggacgtaaaagcaacaattcatgaccggttttcagatttgttttaataaaaaagggtgattaataatgaaaatgattattgcaattgttcaatcaaaagatagcaatcgtttacgaaaagcatttaataaagctgatattcacgttactcaattatcaacaactggtggctttcttcgtgaaggaaatgcaacatttctaattgggattgaggacgaccgtgttcaagaagtattatcagtaattaaaaagaatgctgagtcacgtgaacaatacgttacatcgcaaatgcatatggatgttgaaggcggttcggcatttcctgtcaacgtaaagattggtggggcaactgtctttgtcttaccagtagaagacttcattaaattttaagtaggtgaagatggttggctgaacagggacaaacacgtgcagaaaaattacaaccagcaataattactcgttttcaaaaaatattatcaaataatgagcttgctcatgcttatctgtttgttgggccaggtggttcaggaaaaatgtcaattgcccaatggttatcattacggttattttgtcttcatccccaggacaatgaaccagacttaacctgtgccgagtgtcagcgaattttatctggaaaccatcctgacattgtctatgctgctccagaaggtcgccaaataaaggttgatgagattcgccgcttaaaagcagagttttctaagagtgcggtagaaggcaataagaaaatttttattattaaagatgctgataaaatgacaaacggtgcagcaaatagccttcttaagtttattgaagaaccaggagctggcgtttatatctttatgctaacgactaataaaagtgctgtcttaccaacgattcgatcacgaacacaggtgattgaactaccaccattaaaacgagatgcattgttaacggttttaactgagcataatattccgcaatctcaacaacaaattgctgttgggattacagattccgttgcaatgattgaacaatggcaagaagataattggtttgagagtgcgatcaaaggagtcattcagtggtatcaagatacgacgcgaaatgggatgttaggttttgttgatgttcagacaattctgcaaaaagtagctaccgaccgggataaacaacaagtagttctggacttaattaccttaatctggcgtgatacgctaatggtaaattcgggaattacagcagccaaccgtcttcactttaataatattttaggagaaatgggagaagtagttagaaaatactctcctcaacaattgttagcagctagtcagttaacgttggaaactcgtcatatgttagaacaaaatattagttttcaaaatattgttgaacaattgacgattcggcttgtgcaggttttaagcattagttaggggcgaaaagatgagtgaagaatatagttcagataatctttatgaacaatttgcgcaggtgatgaaccagactcaggatttggttaagaaaatggagcagttgcaggcaaaaattattgctatttctgaggaaaatgtggaactttcaattgaaaacaagcatttgcgtcagatgattaaagaaaagcagccacaccatagtgaaaatcaattatctggatcacggcaaaatttaaaagaactttaccaacagggattccatgtttgtagtgagtactatggtaagcgtcttgagcctaatgaatcttgtactttttgtttagatgcaatatttggacacgaacaaggaatgacaaaataggagatagtatgcagcaaattagtagttttaatgatcaccaatcaggaagtttatatttggttccaaccccaattggaaatttagatgatatgactttccgtgcaattaaaaccttaaaagaagtggatctgattgctgctgaagatacacgtcatactcagcaactattaaaccattttgatatatcgacccgtcaaattagttttcatgagcataatactgaacaacgtgttccggaattaattgagaaattaaaagctggttattcgattgcccagtgtagcgatgcggggatgccttcgatttctgaccccggcaaggaattggtagcggcggcagttagagaaggattgccagtaattccgcttccaggagctaatgcaggattgacggctcttattgcttcggggttagttccccagccgttctacttctttggctttttagagcgtaaacaccagcagcaagtaacagcactggagcaattgaaagagcgtaaagaaacgatgatcttttatgaagctccacaccgcttaaaaaagactttagctacgatggcggaagttttcggcaatgaacggcgagttgtattagcacgggaactcactaaacgctatgaagagtttacccggggaacgcttgctgaagtaactgcctggtttgaagatcaccaaccacgaggcgaattcgttattctggtagcagggaatgagcaccccacagagaagacggataatgagattgaattaccattaacagagcaggttgataaggaaattttaaatggcctttccactaatgctgcgattaagctggtggcaaagaaaaataatataaaacgccaggaattatataaacaatatcatcaattgtaggagaaaagtatggagttaaagcaagaagcacaaacattcgaaatgccgcacttactaacatattatgagtgtgatgaaacaagtcatccaagcctaagcatgatattaagtatgatttccatggtatccgatgagcatagtatgtctttaggaatgggcaccaaagaaatacaatctactggcggtacatgggtagtaagcggctatgaaggacatctttccgcaaagcaaccttcttttggcgaaacagttattttaggaacaaaagctgtttcctataaccgcttttttgctgttcgtgatttttggataacgggtaaagaacaccagattgaatatgcacgaattaggtcgatttttgtgtttatgaatctaaagacgcggcgaatgcaatcaattccaccagctttaattgaaccgtttaatgctcccgttgcgaaaagaattcctcgtctaaagcgacctcaaaaattggatgaaaatgcttcggtaataaagaagaattatcaagttcgttattttgaccttgatgctaatcaccatgttaataatgctcgttactttgattggcttcttgatcctcttggccgtgattttttacgcggaaatcagataaagagatttaatttgcagtatcttcaagaggtacgcaatggagaaatggtagaaagtaaagttaataagcttcaaacaaatgatgaaaaggtaacttatcatcagattggtgttggtgagcaaattgatgcaattgctgagatagaatggtattaaaaattaatcaatgaataatagcgactggtttctagacaggaaattagttgctattttattttaaccttaaatgtagacaaaaagatcttgaatggtttaatgtagagacatttaaaggaagatggtattctatgaatagtagtaattatgaggagtgagttgacgtgaaaagatctttaacggcgattatttacctcgaacccgatcaggttaatttacggatcattgagatacctactttaaaagtgataaataatgttcgatcgggccttctaaatatcgggaacgctaaagttgctaattattcagaaaacatgactacaattgttaataatattgaaggatttaagcagattattaatgactaccaggcaacaccagttaaattttatggcgatttagaagaccttgatccagttgcaactaggtatgtggccgaccagttagaagttcggacaggattacagattgaatggttaaacaataaccagctaatggcacagtcgatgagttaccttttaaccttgctaccagattttgaaaaacttagtaaacacaatatgtatcttctaagtatcggtcttagctcgactaccttagcttattttcaccatggaagcttcgaacgtgcctgggatattgatcttggtaatgcaaaaattagtcagttggtgggccgtcttcgaaaaactgccactaatccaactgaaattattcaagattatattagtagtaaactagagtatttaacaccagaactgacgaagaaaaagcatacagtaatgatggtgcaaaatgctctctcactcaataaattgtttttaccacatgatcagcagatcgctgaagtaccgctagataaatttcatgatgattaccaaaaaattttatcgccagtcaaagatggtttgatgaagagtattcagattgatgaccaacaatttgaattattattaccaaattatttagtaacggcgcgaacagtgcgcttaattcaaccagcaggcctttacgtaacggatatttcaacgatggatgggatttcccatggaattggagttgataatcctaaaacgagacggcaaattaatgaaatgatcagaacagctgccgacaatatttcttcacgatacggtgttgattcagctcatcgggattttgtaacgcgcttttcactccaactctttgatcaattacgcccaattcatcgtcttggtcaacatgagcgattattattagaaattgctagtagaattgatgatattggtaattttattaaccaacgaggacactatcgtcactctgcttatattatggaggctaatcctttaatcggcctttcagataaagataatcggattattgctgaagtggcaagatatcatagtgcagagtctccagatattagtcaagctcattaccgtcatctcgatgatgagatccagatgccagtagcaaaattagctgctattttacgattggtggatgcattagatgattcgcgactgcaaaaaatttcaagtattaaattgaagctggtaggagatagccgcttaatcattaaagcaatagccaatgatgaccttgttcttgaaaagtggtcttttagtaaaaaatcacaactatttaaggatgtatacggaattgaaccggtcttaactgagaggagtgatcattaagatgtataaggagttttataagccgcagaattatgttaatcgagaattgagttggattgactttaatggccgagtactgggagaggcaactgatactgccaatccgttgttagaacgtgctaacttcttgggaattacccaaagcaatgttgatgaattttttatggtgcgtgttgcctcgcttcataaacttgctgctgccaacgttactactactgatgcgtctggtctcactccagaagagcagttggatgcagtaaatgaaaaagaacatcggatggttaagcaacggtatgaagtttacaatcagcaaatcatcccagaccttgctaaaaataatattcatattctccatgtccccaaacttgacgagaagcaatatgaatttattcggcggtactttaatgatgagctgatgccagttttgactcccatggcagacgatgcctcacgtccgtttccctttatctccaataattccttaaatattgctgttcagctgcggcggcaaattcatccaacaagtaaaccagttgcagaggaaattttagaaggggatcaagaagttcatcgtccacaaattgaaccacatgatgatcgacaggaagcagatatcaaatttgcaacagtccgtgttccggaaatttataagcggttagtccggctgccaggagaaaataatttcattttgattgatgaaattattactgaattccttaccgcgctttttcctggatatgagatattagctacggcatcatatcgagttatgcgggatatggacttagacgttgctgaagaagatacgtcagatttgctccgagcagtcaaacggcaattgcgagaacgagaacacgggcgggtaatgcgcctagaagttccagcttcaatcgatgaatggttaaaggatcagttaattgataatctgcatgtaagtgaacgatcactgtatgaagtagatggtcccgtcgatctaactttcttgaaaaaattatcggggatggttgatggtcatgatgacttgcgctatccgccatataagccatacctcaatccagcgttagatatggaccataatattttttcttccattcgccaaaaggactacttaatgcagcatccttatgataattttcaagccgtggttaactttatccaccaagcagccattgatccagatgttttagcaatcaagatgactctttatcgggtctctggtaattcaccgattattaagtatctcggaatggccgcgcaacagggtaaacaagtaacggttttagttgaagttaaagcgcggtttgatgaacaaaataatgttcgatgggcacaacggcttgaacaaatggggtgccacgttatttacggtttagttggtcttaaaacgcactgtaaagttgccttggttatccgtcgtgatgaagatgggttgcgacgttatatgcacctagggactggtaactataatgacgtaacagctcatttttacaccgatatgggattatttacttgtgaccatgaactgggaatcgatatgacgaacctgtttaatatgctgtcaggttttgcgcgaccagcttattttaatgaattacgggtatcacctgatggaattcggacatttattaatgccaaaattgatgagcaaattgaaaatgccaaaaatggtaatcctgcgttaattcggatgaagatgaattccttgtctgacaagcaaatcattgcccgcctatacgcagccgctgctagtggagttaaggttgaattattgattcgaggaattacctgtttacggaatgatctgccagaactgcatgggaatattgaagttcattctattattggacgtttccttgaacactcccggatctactactttaagagtaatggtcatgaggaagtctaccttgcaagtgccgatatgatgacgagaaatcttaatcgacgggttgaagaattgtatcccgttacccaaccagacacaaaagctcatgcaattcatatttttgacgttatgtggaaggataatgtcaaggctcgccggttagtaggagatcattatgaacggattgatcgtggtgatgctgcaccattcagctcacaagaatactttgttaaacaagcaatgaaattgaatgcgcgtgagaaaaaggagaagaaagcaaaaaaacatttttcttcagtttttgaaactttaactcgccatgttcccaatcttcatttagatgagcgaaaggatgagtaatttatgagcaatgagcagtacttggcaattcttgatttaggttcgaattcagttcggcttaaaataacaaaaattcaagataacgggagctttgaaacggttcaatacgaaaaaagatacgttcgtcttgcttcaaatatggggccagaaaaaatgctgaaatcaactcccgtaaagcggactattgatgccttaaaagaatttcgggcaatttgtgatcgatatcgaaataagaatctgacaattattgcggttgcaactgccgccgttcgtcaagcgcaaaatcaactgcaatttcttgaaaaggtccagcgagaaaccggttttgaaattcacgtaattagtggggaacgagaagcatatcttgactatgttggagttaaccagactcttccaattgataaggggataatcattgatactggaggagcaagtatggaattaatctcggtaaataatggtgaagcagaaaaagcggttagtattccgatcggctcagtcagcatttcgcaaacttaccaccttgaagatcagattaatccagctgatttatttgatgccatggttaaaattgatgaggtcctctctcaacaattgtggttgaatcggatgcgggaaacaaagattgtggcacttgggggatgcaaccgtgcattggcgaaggtatatcggtggcaacaagcccttaatcctgatgaagtcagaccggttcatgggctaacaatgcgttcagaagaagcctttttgattatgcggcagttattagaagcggatcggcagacgcgggcaggaatccgtggaattacgaaagtgcgagcagatgtaattgtcgggggtcttttaccactcatctctcttgtccggcaattatcaattaacgagattagttttagtaatagtggattaagagagggcttattatttaagtaccttgagcagcagattaattttaatcagctaaaatcttcactataaaattatctgctaaaaactttactttctttttactaaattttactaattagaaccagtaaaactgtgctacaatcactatgaaagctttagttggatcaaggaggaaacaagatgtcaattttagttgctggtggtgccggatatatcggttcccatatggtaaaagatcttattgaaaatggtgaagacgtagtagttgctgataacttatcaacgggtcaccgggatgcgattaatcccaaggctaagttttacgaaggcgacattcgtgatcgtcaattcttagacaagatttttgacaatgaagatattactgcagtcgttcactttgctgctttctcaattgtccctgaatcaatgagtaagccattgaagtactttgataacaatactggtggaatgattactttgcttgaagcaatgcatgaccatgatattaagtatattgtctttagttcaactgctgctacttatggggttccagaacatatgccaattaaggaaactgatccccaaaagccaattaacccatatggcttgagtaagttaatgatggaagaaatgatggattgggctgataaagcttatggtattaagtttgttgccctccgttactttaatgttgctggggctgctcctgatggcacgatcggtgaagaccatggaccagaaacacacttagttccaattattcttcaggttgcgcaaggtaagcgtgatgaattgagtatctttggggatgactataatacaccagatggtaccaatgttcgtgactatgttcatgttatggatttagcagatgctcatattcttgctattaagtaccttcaagaaggtaacaagagtaatgcctttaaccttggttcatccactggcttctctaacaagcaaatgctagaagcagcccgtgaagttacgggtcaacctattccagctaaaatggcaccacgccgtccaggagatccagattcattagttgctgctagtgataaggcgcgtaatattcttggatggagtcctaagtatgatgatgttcacgacattatcgcaactgcttggaagtggcattcaactcatccaaagggttatgatgatcgcgactaataatcggttttaaaataacaaacaggctctcagtgacgtgtacccccagagttggaaatcaactctgggggtattttatatgaccaaaattagcgttaaaactaaacttaaagctgttgaagaatatgctaacggtaatgttactttagcatcagttaggcataaatacgggattgctgagcatgatttccaaatttgggtgggaatttatgcaagatttggtaaaggaccattactcaatccacccaaagtaactggggattttcggttaaatctggtaaagtggaaacaagaaaatttggcgtcaatctcagaaacttgtattcactttggatatcgttccccaggttcagtgtatcagtgggaatgtctctataacaagcaagggccacaggctttactgagattgcgtcggggaaggaaacctaaaaatggtcaaacgacacgacaagaatcaagacaagcttcttcagctccaaaaacagaaccaaaccttacaaagagaaaacttattgttaaggatacaactcgatgcctcaaaaaaattgacagccttgagaaagcatccaaaaaagaactcgcacaagtaatttatgacctcaaggctaaatacttattaaaggatttgatcgatgcacttcccatttccatgtcaacctatcagtattggcaaaatcggtttgaacatccggacgaggatgaagaagaacttaaagccgttattaaaggcctctttaactacttccaagctgaatacggcgtacgccgtttaagcactcaaattcgagactactatcgcttaattggtaaaaagacacctaatcataagcgcattcagcgcttaatgcatgaaatgggacttaaatgtatcaaatataatcggcgagtccgtaagtatgattcctctaagggaccaaatggcaagaaagctaagaataagctaaatcggcgttttatgagtaaccgtaaatatcagaaaatggtttgtgacattacagaattaaaggctcatgatgggcgaaaagtgtacttagaaattattaaggacttggcaactaaccagcttctcacttggtcagtcagtcaacatccaaatcttcaattcgcattagatccactccagcaattacttaagcagttacctcatacaggataccaattaactttacatactgatcaaggctggcactattaacatcgtgcttggcgcaaactacttcgtcagggaaacattaggcaaagcatgtcgcatcgagcaacctgtctggataacgctgcctgtgaaacagtctttagtaaactgaaagcagaaattggtcctgataccagttatcgcaatcaagaagaattaagccaagcaattaatgaatggattcacttttataacgaacgctgtattcagacaaaactaggcaaccaaactccacttcaatatgagcagaatctagttgcctagaaaaatatttattcaattttaaagcaagaacatacaggttccaactttaagggtacacgtcacagcaaaaaaatgttggggcctgttttgtcgtaaataaacaaaagaaattaaaagagaagtcaaagctgatccagtgtgataagatgtaagatgattgaaaggattgataaaagatgaagattctagccatcgatacatccaaccacccaatgagcgtagcgttggttgaagatgagcaattgttggcaacgacgacccttaatatggttcgcaatcatagcatttatttaatgccggcaattagtaagttatttgaattagttcagtggcaaccaacagatattgatcgagtagtggttgcacagggaccaggatcttatacgggagtgcgaatcgcagttacaaccgctaaagtattggctgatacagaaaagattgacttagttggcgtatcaagtctagcagtgttagcacgtaatgtaattccaacagcatcagcaattattgttcctttctttgatgcccgccgaggaaatgtatttgctggtgcttaccagtgggaaaatggcaagttaataaataaaatagaagatcagcatttaggaattgatgttttgcttgagcaacttgcaagattaggtcaacaagttgttttagtgggtcatatgactgataagattcaggccaaatatgatcaattgccagctaacgtgacccttttgccacgatcttatagcattccgtcaacgtatcaattagctcttgctggtgaaacgaaggaaccggttaaagagattgacccctttgttccacattatttacgaattactgaagcagaggctaattggcaaaaacttcatcctggagaaaaaagaaagaattatgttcgagaagtttaaagaatggtttgtcaatacgaccaatcctactaaacgaccgacccttgattttacgcgacgagtagtaatgatatccggccatcagtatgtggtccggatggcaaaagaacaagatattcaaactttagtcgaaattgaagaaagaatctatggaaaagcaccatggagttatgctgctttccgcattgaactacagcggccatgtgatcgactatatttagttattgaggatgaccagcagattgttggctttatgggaacagccattgactggtaccattatgatttgcatattacgaatattgggattaccccaagttaccaaaataaggggattggaacgtatcttatttcaactgccaaaaattatgcccggcatttaaaattacattcgatgagtttagaagtacgagtgcataatgtatcggctcggcgcttatatgaaagtttaggctttcgcaaccagcatattaaaccccgttattacttagacaatcatgaagatgctgttgatatgcaagcaaacttacttaggtagaggtgaaagtattttattatgacagaacgcacattaaccttagcgtttgaatcaagctgtgatgaaacaagtgttgccgtaattgaaaatggaactaaaatcctttctaatatcgttgcaacgcaaatcgatagtcatcagcgctttggtggagtagtaccagaagtagctagtcgccatcatattgaacaaattaccaagtgtacaaatgaagctttagagcaagcagatgtagactataatgacctagatgctgtggcagtaacatacggtccgggattagtcgggtcattattaattggtgtgacggcagcgaaggccatcgcatgggcgcataatcttccgttagtgccggttaaccacatggcaggccatatctatgccgcacgctatgttggagaattccaatatccacaaatggcattgttagtttccggtggacatacggaattagtttacatgccatctgaacatgaataccaaattattggtgaaacacgtgatgatgctgccggtgaagcttatgataaaatcggtcgcgtgttgggagtcaattacccggcaggaaaaacgattgatgaatgggcagctaagggtaaagatacttttaattttccacgagcaatggaaaaagaagataattatgactttagctttagcgggttgaagagtgccttcatcaatactgttcataatgcagaccagcgtggggaaaaattagataaatatgatcttgcagccagtttccaacaaagtgtcattgacgtgcttgctgaaaaaacgatgcgggcgttagatgattacccagtgaagcaactgattttagctggtggggtcgctgcaaatcatggcctccgtgctcgtttagatcatgatatgaaggaatttcatcctgatgtacctatgctgcaagcaccattgaaattatgtggtgacaatgctgcaatgattggggcggctggttatgttaactacaagcatggtgaccgtgcaggcttagatttgaatgcagtaccgggattgatgtttgatcgaattcagagtaaataattataaacacaacttcccgtaagcagtaatggcctccagtgttcggtaaaaaaccggacgctggaggccattattatactgtgctgtatgaacgtaaccacagcccttttttgcgtttatgattcaccatttgctttatcaacggcatccatcacggcgtaacggaaaccatttttctccaatgcttccacacccttgatcgttgtacctgctggtgatgttacttgatcgcgtaataatgccggagcaagcttgctatcataggctagtgttcctgtaccttttaccatgctggcgataacttcatatgcagtttggcgatcgagaccatatttgacggcggcatcgctcattgcgtccatcatcacatcaacgaatgcagggccgcagccgccgataacaccaattatatctagttgtcgttctggaacttcgatgacatcaccaaggctatctaaaacagtcattacttttgaaattgcttcagcagaaattccggttggcagggcaagaccaattgtgccagcattaacttcaactggtgtgttgggaataatattaacaatttctttattcggaagaacttttgctaagtctgcatgagtaattccagcagcggctgagataaaaatagtgtggtcgttaagtacagctaattctttagcgactgcggttgtaataggggctggggtagtcaaaattacgatatcgggtgtaaggttaaccacttcactatttgtattaacgagtttaaacccgagcttctcagcaaggcttgtaacacgtgaattaacaggattcatcgcactgagggtaaaattttgcgtacggcttaatcccttcataattgcgcttcccatatttccgacaccaataattgtaattttcatctgaaaaacctcctagattatttccgaatttgcccattaccggtaatttcatattttattgttgttaattgttgtaatcccattggtccccgggcgtgaagcttttgggtactaataccaatttcagcgccaaagccaaattctcctccatcagtaaaccgtgtggaggcattaacataaacacaggcagaattaattgcctgttggaagtagcgtccccgggtaatgttgtttgtaataattgattctgaatgatgagtactgtagtggttaatatggctaattgcatcatcgagggaatcaacaatttttacggccataattaaatcgttgtattctgtatcccagtcttcctcagtaacggggcggatagttgatactagttggcaagccgtttcgtcaccgcgtaattggactccatgttccattaaagctttggcaatgacaggaagaaatttagcggcaatatcgcggtggataagtaatttttcagcggcattgcatacagaaggccgttgtactttggcgtttacagtaatattggtcgccattgttaggtcggcatccttatcaatataaatgtggcaattacccgcaccagtttcgataactgggaccgtagctgttgttacaacacgctgaataagagcccggccgcctcgtggaatcaagacatcaatgtagtcagtgagattcatcatttcatcagcaatcgcatgactagtgtcggtaataagctgaaccgcatcgaccggtaaatgttgactttgcaatgattcgcgaagaatttttactaaggcagtattagtctggatagcctcttttccaccccgtaaaataactgcattgccactcttaaatgtgaggccggtcgcgtccacggttacgtttggtcgtgcttcaaagataatgccaattactcctaatggtacgcgccgttgaaggatttgcaacccatctttggtaatccatcccttatcgatttgggaagtgggatcgttcaagtcagcgattgtccgaagaccattagccatgtccgcgatacgttgggagttgaccatcaaacgatccgtaaatttagttggcatttgggtagcagcggccaaatcttgttggttagcagcaataatttggtttttatttttaatcaaatcatctgccaattgaagcaatgccttatttttggtggcagtattcattaaagctagtttatttgcagcattttgagctctttttccaattgcgattaagtcttggttcattatcatcactcctattttccaaaatgagtaccaatagtatgaccatcaaaaatatcaaaaagaattttagggtcacgaccattgcataaaatcatttgtttgcctgcttgcatcattgtggcagctgcccgtaatttagttaccattccgcctgtcccaaatctagtgctgctaccacttgcggcgttctctatttcgggcgttaggactggcacttctttaattatgtgtgcgtcagaaaatttatgcggatctttgtcataaagggcatcgatatccgaaagaatgattagttcgtcagcgtcaatggcgacagctacctgggaagaaagttcatcattgtcactaaaagtagtgtaatgatcaagctcatcaactgaaacggggtcattttcgttaacgattggaatcacattttgctgcagtaaagtattaattgtattaagcgtatgctggcgactaataggataagtgagcacatcacgggtaaggagaagctgggcgacgtgcgtttgataatctaaaaagcgttgcgaatagattcgcattaaagcagcttgaccgatagatgctagggcttgctgttgtgctatttcggcgggacgatcttttaatcccaaacttgcaagaccaacgccaattgctcctgaggaaacaagaataagttggtatccttgattatttaatgtcgcaaggacaaaggagagttggtcgattgttcgtaaattaatttttccattagggagaacaaggctactcgtaccaatcttaacaactgctttttgtattttatgagtcatagaaaatcctttcaaaaaaacaaaaagcgcccttaaccgagacaccaattatggcggtaccattctcgtttaaagacgcgctttacacttttaaattattttattattagaatatattaaagttgtagcagggcttcggtactggcgatagcttgcagtcgatgactatcgttcctggactgacctacttttatctacaattaaaattttaattggaatactaagcttttgtcaagactaattatttttgaatgttaattaaaaagagattgacaaattattagaaataaattagaatgcggataacaattaaatattagtcgtttaagaagagtaaaagcaatgcagtattaagagagttttcgggtggtggaagaaaattacaagttgctttgaagatggtcttaaaaaatacaacaagtgtgaggaaaaaaactaagcgcttgtcggctgatatccgttatcaagtatcgaagtttattatgaacttcctgaggctattcatgtgagtggatagtaaattaaggtggcaccacgaaaatactcgtccttatttaagttaaggacgggtattttttatggaggtgaaagtgatgagacgcaaagttgcattagctcaacttgatattcaattaggaaatcctgccgaaaattatcaaaaagctaaacaagcaattgaagaagccgctaatcatcatgcagatatcgttgtcttgccagagatgtggaatattggctatgccttagatcaattagcagaattggcagatgaaaatggtcaaaagacgcaacaattctttagtgagttagcgctaaaaaatcaaattaacattgttggtggttcagtagcggttaggaatgggcaatctttttttaatacaacctatgtctatgatcaaaacggaaatctaattagcagttacgagaaggtgcatttattcggactaatgaatgaagatcaatatttagaagctgggcaaaaagaaaatcattttaagttagctgggattcctagtgcaagctttatttgttatgatttgcgtttccctgaatggattagaacagttgctcgttatggaactgatatcttatattttccggcagaatggccaagcaaacggattgagcagtggaaaataatgttacggtcgcgggcgattgaaaaccaagcctttgtagttgcagtcaatcgtgttgggacggatttagagaatagttttaatggtcattcgttagtaattgatccgcttgggcaggtcatccatgatgcaggagaagtggaacaggtaagttacgcagaaattgacttagcacagttagcacaggttcgggggccgattccggtgtttaaggatcgccgaccaagtctttatcattaaggggatgggaaagatgaattttgaacaatctaaattattagacactttaccgaaacaattttttgccaatttagttgccaaggttaataaaaaaataggggaaggagttgatgttattaatcttggtcaaggaaatcccgataaaccaacgccagattatattgttaagagcacgcaaaaatgggtagcagatccgcaaactcataagtattcactatttcggggattgccagcatttaaagaagcagcggcaaaattttattctgaaaaatatggagctgattttgacccagaaaaagaagtagcaattttgggtggttccaagattgggcttgtagaattaccatgggcattgatgaatcccggcgacacttttctgcttcctgatcctggctatccagattacttatcaggagcggcattaggagaagttaattttgaaacagtgccattattagcagaaaataatttcttaccagacttagaggcaattcctgaagaggtggcgcaacgtgctaaattcttctatcttaactatcctaataatccaacgggtgctgtagctactcccgagttttatcgaaaattagtggcgtgggctaagaagtaccatgtgggcattattagtgactttgcctatggcgcaattggctttgacggccaagcaccagttagttttatggaaacaccaggcgctaaagatgtggggattgaattttataccttttctaagacgttcaacatggcaggctggcgaatcgcatttgcggttggtaatgcagatattattgaagccttaaacttaattcaagaccacttattcgttagcctttttcctgccttacaggaagctgctattgatgccttgacgctgccacaacgtgatgctgcaattgccgaaattgtaggtcgttatgaagaaagacggaatgcctttattaatgcggcagaaaaaattggctggcatgcatttactccccagggtactttctatgcttggatgccggttccgaagggctacaccagtgaaagctttgcagatttgttgttggacaaagctggcgtggcagtagcaccaggcaatggctttggcaagcacggtgaaggttatgtgcggattggccttttgattgagccggcacgattaacagaagccgttgagcggattgctaaactgaatttatttaattaagggggaaaagattatggctttgaaatatacggttttaggtgcaggtgcaatgggtctacgatttggcgtattgcttcaagaactggctggcgctaaggttgattttgttgataactgggctccccaagttgaaaccattaaacaacagggtggggtttatgtttctcgggaccatgaaaatcgtcaccttgtcccgattaatatttactcacctgaagaatatgattgggctccagatgtattgatcgtttttgctaagcagatgacgcttagtgatttgttacaacgcagtgcccatttcttccgtcctgaccatcaatatgtcttttcggggatgaatggcatgggacatattgaaaaaattaaccactattttcctaaagaacatgtcgttgccggtacctgtttaatcggcacggtccttaataaggcaggggatgtggactttattggtaaatctggtgctggttcgatcaacttagctccccaagtcggcgaaccagatgagcgagtaaaacaaattgttgaggactttaccacggcgaatattaacccccaccttaatgataatttttatggtaccctcctaacaaaagtagtcttcaattctgttattaatacgatctgcacgctttttgagattcaaatggggcaatttatcgattacgatggtgcagaaaagcttggtaaacaattaattaatgaagcatttgatgttgccgaacgggctggtattcagctcttaagcacccgtgaagaggagtggcaaacgattaaatatgttagtgaagttaccaacccgcttcattatccatcgatgtaccaagatatgagtaagaatcgaccaacagaagtcgactacattaatggatatatttacgacttgggtaagaagtataactatgaagcatctactcacgacttcttgcgtaatttagttcaccttgcagaaaatactcgtaaattccgacaaaactaagaggccgggaattaactattaatttttggttctcaaacagtaaaatccggactatgatttttgatcggttcaaaaatcatagtccggattttaaattatttatgaaattagtctccaatcgactaattgattggccaaatttcgttagatttaatgccatcagggctagcccaatgtcattttccacagcccgttggccacggagatgagttcggcgtatgccaaaatccctcttcatgtgaccaaagactggctcaacgtcgaacttccgtcgacgataaattgccttgccttcgtcacttgagagggcatctttaactttagctttataataattccaggttgggttaaccttcatataacgttgacgaccacctggtgtcttcgctagttcatctaatttaactgatagttgatgtttatcagcacgatagattttaaagtcacgcttaaagccatacttatcagtggatttactatagcgataaaaactaaaacgaactccttgatgatcaatgtagtagtcgtcattagcgttatattcccaattctgtgacctagttggatcgtttttaaatttacgtttctgttccttttgataggttgtgtatgggataaccggctgcttttcaaaccgatcaagaatcattgtgtaattgtactcacttccatagcctgcatcggcgacgatatgttcaaagaaatctaaagcatgaaactgggtaaggaatggcactaaggtcctggtgtcagttggatttgaaaacagcccgtaatcaagcacaaattgcttatgggtagcgatttgcaggttatagccaggcttcaactcccgattcatcatcggatcttccttcatacacataaaggtcgcatcgtggtcagttttggaatagctattacgaccttggaagatattttcagcacgttcatacttttgggcacgcggaattaggtcgttgcttaattggtgacgaagcttttttagaaaacgacggcgccgttttctaactgaaccccctttgatgatttttggttcttgcttaatcttttcatctaatttagtgattttctccgccagttcttgttccattacttccatgccttcggcggaagtaaccagctccggtgccatttcctgtaccacttgcttttctactagttcctcataaagcttacttgtcttttctcttaacttagcgtgatacttttcaactgcccgccgccaagtaaatgaatatttattggcatcggcttctaccttggtcccatcgataaaaactgcatcattttgaattagtccgtgatctttcaaagtcatggtaaagtagacaaaggcatgtttaattagcttactagcgtgctgactgcggcgaaagttattgatggtatggtagctataagtataatcatgggctaaccaacgcattggcaggttctcatccaacatcatttcaatctttcttccagaataagtttgacgtgagtaggcaaacaagagaatcttaagcataattgctggatgcgataaagggcggccggtagccgctcctgaatcttctaatagcacatcttgtggaatcgagtcgacaaaatcactaattagtcgcgcaacatgattctgtggtaaatcatagttatagtttagtacgaattcggtttgccctatggtataattttgatacatggaaatcgctccctttggttgtttttaggggtaattacatcatatcaggaacgatttcctgtgtacataaaaaccggatgatgaattgttcaaaaaattcatcatccggtttttattttggactaggagttttttcccagcctctagttttcttgatcaaattcttccagtttttctgctgcttctgtccatgcaagttcgacctcttcggatttagctgataattcatcaagttctttttggagatcggttaattttccaatatccgtagcgatttctggttggctcatttgttcttgaattgcagtttgcttttcttctaattccgtcatctgttgttctagttcatcgacttgtcgctgaatttttcggcgagcacgctgttgttctttactctgctgataagattgcttaccagctggtgctttagcgatcgtgttggaattatgcgaagtagctttaggtgaactttctttttccttagcaactagatagtcatcataattgccttcataatgtttaattccatcatgttccattgctaggatatcggttgcaacctgattaataaagtaacggtcgtgagaaataaagagaacggttccgctaaattcgttaattgcgttttcgagcacttctcgactatcgatatctaagtggttagtcggttcatcaaggataagaaaattaatcggtttaaatgagagtttagttaactccaatcgtgccttttcaccaccagataggtcatgaacgactttataaacatcatcaccaacgaataagaaactacctaataatgagcgaatatctttttcaggtacttctggatggtcatcccatacttcttctaaaacggttttatttgggtgcaattgttgttgttcctggtcatagtaaccgatatcgaggttagcaccgagtttgattgttccactaattaacggaattttatggagaatagatttaagtaaagttgattttccgattccatttggtccgataatcccaacacgctgcggcttgcgaacattaaatgaaagcggcccagcaaggatctgttcatcgtagccaacttttgcctgctccacatcaagaacttcatttccactatctttttcagaatggaattggaaatggattgatttatcatcagtttctggacgctcaagccgctccattttttctaattgctttcgccgcgcctgggcacgtttggtcgttgaggcacgaacaatatttcgattaacaaagtcttctaacttagcaatctttttttgttgttggtcatagtgtttccactctgcctgtaatcgttcttgcttgtgtttaacaaattgcgtgtagttaccagtatagtgggtgagtgttttattatcgagatcataaacatcgctgacaacacgatctaagaagtaacggtcgtgagagacgataagcaatgcaccttgataacttttaagataatcttctaaccatgaaagaacgttcatgtcgaggtggttagtcggttcatctagaatcaaaagccccggtgcttgcagaaggatctttgctaaggcgagtttagttttttgccctcctgaaagggaattaattggcgtatcataactatcttcgccaaaaccaaatccatgtagaattccccgcatacgtgattcgtattcgaaaccaccccgtttcttaaaggcagtttgtaaattatcgtatgttgaaagaatttgttgataattgctctcggaactatcaaggtcagctagttgctgttcaagatcatggatttgcgtttccattttgtggagaggagcaaaaacagtatctagttcagtccaaatgctattttgactatcgagtccttgatcctgggccaagtaaccaattgtcaaatctttaaccttcgtaattgttccttcatctggttcggtgattccagcgatcatttttaacaaggtcgttttaccagcaccattacgcccaacaagcgcagtacggccatgctcttgaatttgcatgttcatattgtgaaataaaacgtccgcgccaaatcgacgcacaacgtcatttgtctgtaaaagtaacatattgaaacctcatttaattcgttgatttaatatggttttattttagcagatttttaattttaaataaaaagttgaaaatatttttgtattttagttcacaaaaaagggtttaattgctagaatatactcagacttaaatttcacaaagtaaaaattagtaacattatccttgtcaaaaacttagtaatttgttggcaaactaggttgagaagggcttattttaggaggaacaaaagtagaatggctaataaaaagattccacgcgcgactgcgaaacggttgccaatatatttccgttatttaaatgtattgaaagacgcaaataagcaacgggtatcatcaactgaactttcggaggctgtgcaagttgattcggcaacgattcgtcgtgacttttcatattttggtgaattaggtaagcggggatacggttatgacgttgaaagtctattaaagttttttaaaggaatcttacaccaagactcattagttagtgttgccttagtcggggttggtagtttgggaagtgccttgttaaactttaacttccaccaagatactaatttacggatcagtgcggcatttgatactaagccagaatatgctaatacagtcaaaagtggtattccaatttacccatccgaggatatggtaaagcagttaaaagagcaacaaattgatgttgttattctaaccgttccaggaatcaaggcccaacacgttgcggaccaattagttgaagctggtgtaaagggaattcttaactttactcctgttcgtttatctgtgcccaaaaatgttcaagttcaaaatattgacttaacaaacgaacttcaaacattaatttacttcattaaaaattatactgaagattcaattaaataaattaggagagcattggtttgatgaaagcgttcaaccaatgctttttgtttactaaattattaataaaagtcattggttgtaggtatgatctcttaagttttgaaaaatggtcaaaaaaagtcaaagtgtttttgttgcattttaaggagaacatgttatatttaaacatgtggttagcacttgaagagtttgagtgctaaaaataaaatttattaacaagatggagggattaacgtgttaaaaccattaggagatcgcgttgttctaaaagctgaaactgaagaagaaaagacagttggtggaattgtccttgcttccaatgtgaaggaaaagccaactactggaaaggttattgccgttggagaaggtcgtactttagaaaacggacaaaagcttgctccagctgttaaggaaggcgatcgcgtattatttgataagtacgcaggtaacgaagtagaatacaacggtgaaaagttcttagttgttcatgctaaagacttagtagcaatcgttgaatagttaaataagcgaattaagagcaggagacagaaagaatgaaattccttcaccgtctcttttaaataatgaatttaattttgaggtgacataaatggcaaaagaaattaagttttctgaagatgcacggagcgctatgctcagtggtgttgataaattagctgatactgttaagacaacgatgggtccaaagggacggaatgttgttttggaacaaagctatggcacaccaactattactaatgatggtgtaactattgctaagagcattgaacttgaaaaccaatttgaaaatatgggtgcaaagttagtagccgaagttgcttcaaagaccaacgatattgccggtgatggtactacaactgctactgttttaactcaagcaattgttaatgctggtatgaagaacgttacctctggtgcaaacccagttggtattcgtcgtggtattgacaaggctaccgaagttgctgttgaagctttgaagaagatgtcacacgatgtaaagacaaaggatgatatcgaacaaatcgcttctatttcagctgctaatccagaagttggtaagttaattgctgatgcaatggaaaaggttggccatgatggtgtaattactatcgaagattctcgtggtgttgacactagcgttgatgttgttgaaggaatgagctttgatcgtggttacatgtcacaatacatggtaactgataacgacaagatggaagcagaccttgacaacccatatattttgattactgacaagaagattagtaatatccaagacattttgccattgcttcaatcagttgttcaagaaggccgtgctctcttgatcattgctgatgacattactggtgaagcattaccaactcttgtattgaacaagattcgtggtacctttaatgttgtttctgttaaggctcctggctttggtgaccgtcgtaaggctcaacttcaagatattgctgttttgactggtggtacagttatttctgacgaccttgggatgagtctaaaggacgctactgttgatcaattaggtcaagcaaacaaggttacagttacaaaggatactactactatcgttgatggtgctggttcaaaggaagctatccaagaacgtgttgaccaaattaagcaagaaattgctaagtcaacttccgacttcgataaggaaaagcttcaagaacgtcttgcaaagctttcaggtggggttgccgttgttaaggttggtgccgcaactgaaactgaattgaaggaaaagaagtaccggattgaagatgccttgaacgctactcgtgctgctgttcaagaaggatttgttcctggtggtggaactgctttaattaacgtaattcctgctcttgacaagattgaagccgatggtgatgaattaactggtatcaatattgttaaggctgcccttgaagcaccagttcgtcaaattgctgaaaacgctggtgttgaaggctctgttattgttaatgaattaaagaatgaaaaagaaggcattggttacaacgctgcagatggcaagtttgaagatatgatcaaggctggtattgttgacccaacaatggttacccggtctgctcttcaaaacgctgcttccgtatcagcattgcttcttactactgaagcggttgttgctgataagccagatccaaatgctaataaccaagctcctgctgctccacaaggcggcatgggcggtatgatgtaataccatttgactaaaatttaattttgtgggcagaaaagattctaatgtttgttttttcaaatgttgggatctttttttgttggaggaaaatcaatgacgaaaaatgcgaccagtgtctataaatatttagacaacgaaaaaataaactatcaaattgttactcatcccccagtctatacagcggaacaagcagacaagtatgttcaagaatatcaatttgctcgcacgaaaaacctttttctaaaaaataaagctggctattatttagttacaatcttagaaaataagcgtctcaatatgaaaaaattgaaagagaatctatcgactagtcggttttcatttgcccgtccagaagaattagctatgaagttaggaataacaagtggggctgtttcaccttttaacttgtttaatgataaacaacatcaggttacctttattattgatgctgatatctttaagaacgaggatttaataggttgtcacccaaacattaatacggccactgtgattttaggaataaaagatttgcttcaaataataaagcagaatggtaatccggttaaggcggttcaactataaagttaatctaaaaatcttaaattgtggtaaagtaaattagtattaatttttaaccaaactataactgaaaggaactaagaaatggaaaaaatgaagttccagaagataacgctattttctggtgtaatgcttgccttaaattccttaattggttcagggtggttgtttggtgccggaactgctgcaaaggttgcgggaccagctgctattttgtcatggatcttaggagcaataatcattattagcattgcccttacttacgttgaattaggggcaatgtttccagaaagtggagggatgagtcgttatgctcaatatagtcacggtccgtttttaggttttattgctgcatgggcaaattggatttcattaatcacgttagtcccaatggaagcggtggcctcggttcaatatatgagttcgtggccgtgggcatgggcaaattggacccaccactttatgaagaacggtaatattacgactcctggattgttagttgtatttggcttcatgcttgtttttactttgatcaatttctggtcggtaaaattgatgactcgctttactaatttaatatcaatttttaagattttattacccacattaacaattgtgatgcttattgtagcgggctttcatcctagtaattttggtcatagtgtaactacttttatgccatatggcagtcgatcgatctttgaagcagctgctatttcaggaattattatgtcttatgatgcctttcaaacggtaatcaacatgggaggagaaatgattaatcctcataaaaatatcgtgcgaggcgtattgatttcaatgattattactgctgtgatctatgtcatgttacaagttgcttttattggagcaattgatccgaatttattagcgcaaaaaggatggcatgggattaactatacgtctccatttgctgatattgcgatcctactggggatgaattggcttgcaattttactatatatggatgcttttgtttcaccatttgggacaggggttgcgttcgtagcgactgcctcacgagcattggcagcaatgactcataccggacatttgccccaatggctgggacggttagaacggcgctacatgattccgcggtttgcaatggttgtggatctgattttagcagtggtaatggttagtctctttagaaattggagtttgttagccactgtaattactggttcaactttaattgcttatcttactgggccggttactgtaatgtcgcttcgtaaaatggatgctaatctaaagcggccgtttcatccacattttatgtcctggttagcgccatttgcatttgtcttgacgagtctttcaatttattggacaatgtggccgacgactgttcaggtaattggggttatcttattaggcttaccgatctatctttattatgaggttaagtatcgtcacgcatcagggctacgtgacttacgcaatagttattggatgttggcttatcttgtttttatctcaatagtttcttacattgggagtgaaggatttggcggcaaggactggttgaagtacccatgggattttgttgttattatcatctgctcgttaggattttaccggtgggctgtggctagccggatgaaaaaaatcgatcctgcggcagaaaaggttaatgccaaggtaaagatgccagaaaaagatcaatagatatatttgtaggttgcaaaattaaaggataaattgtagtattgttacctacttaaaaagtgtaaaaatcaaaggagaaatagtatgtggcgctatttaaaacgtgttttaatcgggaaaccgttaaaaacccttgatgaagggcaaacacacttaactaaatttaaagcattagccatgctttcttctgacgcaatatcgtcagtagcatatggaccagagcaaattacaactgttctggtaactttatctgcagcagcaatctggtattcaattccgattgcggcagttgtgttggtccttttgttagctatcacgttatcataccaacaaatcattcatgcctatcctagtggtggtggtgcttatgtcgttgccacacggaattgggggagtaatggaggattatttgctggaggatcattactagttgactatatgttaacggtggccgtttcaacgacatctggagttgaagcgattacttcggcagttcctgctttatataaattttcaattccaatcgggatcgttatcgtccttttaatcatgtttatgaatttacggggaatgagtgaaagtgcaaacttcctcacaattccggtatatttctttgttattatgatgattgtgatggtagtatggggtggttataatattgccactggtcatattcattaccgggcaattgtcgattatggaacaccggtatcgggaatgtcatttgttttgcttattcgggcattctcggctggttcatcatccttaactggggtagaagccgtaagtaatgctgttcctaactttaataagcctaaagaaaagaatgcatcaactaccctggcaattatgagtgctattttagcgttcttctttattgccgttatcttctttagcttttatctgggggtagttcctaattcacggacaacaattctctcccaaatggccgcgcaaatctttggtggacatgggctaggtttttacttgttgcaactttcaactgcaatgattttagcagttgctgctaatactggtttctcagcctttccaattcttgcctttaatatggccaaagataaatatatgccacacgcattcatggatcgtggtgatcggttaggctactctaacggaattatttccttggcgattggagcaattattttgatcttgatcttccacggtcagactaatatgttaattccactttatgcggtgggggtatttgttccatttactttatcgcaatctgggatgattattcactggtttagagaacgggaaggtttttggttaggaaaagcctttattaacctagtaggagccttgatttcatttgttcttgttatttgtttgttctggcaacactttgcaaatgtttggccatacttaattatcatgccgctgcttttatggatgttccattcgattcaccggcactatgtaaaagtagccgctcaattgcgggttgctgaaaagacgaaagtccaattacatgattacgatggcgcaacggtgattgttttagttggtaatgtaacccgagtaactcgtggtgcaattaattacgctcggtcgattggtgattatgttattgccatgcatgtttcgtttgatgaaaacccaggcaaagagcataaaacagcaaatgaatttaaagctgaatatccagacgtccgttttgttgatattcactcttcgtaccgttcaatcgctaaaccaacattacgtttcgttgatgtgattgccaagcgggcagaagcaagaaattattcgacgactgttcttgttccgcaatttattcctaagcatccatggcaattggccttgcataatcagaccagtgttcgtttacgggcgttattgaattcccgagagaacattattgttgctagttataactaccaccttcaagaatagtttattagagagaaagtattgatttaatgaataaaaagcaactattatggggacttttgtttgcaattggcctatttatggcagcaagttataccattgataatcgtggctttcattctggaatatacggtatcattggctgtgctttaatcttaattgcgtatgcaggaatgaattgggaaaaactgcaatcaaaagatcggcatacgagaaaaattttattgcttttaagcagtattttagggattatcattgtccttgatattgctgaaataattttaggataattaaataaagcttattgaagagattaggtgacataagcctagtctctttttatattgactaataatctaaatcatattatcctgtttgttagtcgactaacaaaaggagagataaaaattgctaataggtcgtttagtaaaacaagctaacaatgcaatgaatcaagaaatgaatgcattcgcgcaacagtatggattgacagggacgcaaatgtcgattattgattttttaacgcatttcccgggaaatagttgtgatcaacaccagattgaaaatgaatttggaataaagagatcaaccactactgtattgcttcaacgaatggcaaagaaaaatttgattgaacgctatccgtcaccagaagatcgccgtcaaaaaatcgttactcttactgcggaaggccaaaaattatcttcagatgtaagtgcgtatattacacaatacgaagagaaattaaaagcagactttagtgaacaagacatttcgaaaataaaacgattcttatcaacgatgataaaggagaaatgatgaatacgaatactaaaaaaatttccgcaaaggttattgcagcgattgtggcaactggattaatgtcattttgtggggtaatagttgaaacttcaatgaatgtaactttttcgatcctaatgcgtgaattttcaattactactaatcaggttcaatggatgacttccatttatttgctcttggttgcaatcattgttcccttatcggcaattttaaaaagttcttaccgaacaaagacactttttacagttgcaagcttattttttattggtggaataattattgatgcactggcaccgtcattttggttgcttttagttggtcgtgcaattcaggggatagggactggaattgcattaccattgatgtttaatatcattatggagcaagttccaacaggtaaaattggcttcatgatgggaattggtaatcttattactggagttgccccagcgattggtcctacttttggtggaatcattgccagcaagcttaactggcggtgggtgttttatttattgattccacttttaattatttcatttttacttggtgaatggggaattacccaaaaatcaccaattgaaaagcaacaaattgatatttttagcatgttaatgattgtcttcatgttctgtggctttgtaacaggatttagtaacctgggaagtcaaccattcatgaccttttcagttggtggcgcattgttaattggaatcttaggaatgggcctttttgcttggcgttcgttaatcctagaagaaccaattttacaattgcgattgtttagaaataaaaacttttctgggcatgttcttggtttctttttaacccaacttatttctttagggtttgcgttccttttaccaaactatattcaattggtaaatggtaatagtgcaatgatagctggcttgattgtcctcccagctggttttgctggagcgatatttgcaccattaggaggacgaattttagataagtttggcgctcgcaagcctattttgattggtacttcattatgtctaattgcacttattgcttttacaatctatgggcagcatttaacaagtacatttattgcgcttgtttatattctctatatgggtggaatggggatgtgcatgggttgcgtaatgacaagtgcactaactgttattggtaaagaaaagcaatcacaaggaaatgcaattcttaatacccttcagcaatttgcaggggcaattggtacttcattggtagcgatgattgtagctgctaatcaatcacacttaaatgttgttcgtcgggtctcaacagcaattggtactcaagaagcctttggtatgttaacggttttttgtattataatttggataagttactatcgaagtgtgaaaaaataaaatattaaaaaattcaggctagaagattctaacctgaattttttaatatggaatttcgttaaagcgctgatcgccttcagttatttgaagctggttgttaaaacgattaatgagcttctctttgacattttttaagtccgtttcgtttacataaatactggtttcaacattaactccatactcttcaccggcgacctcaagattattttccttgagatagtaaagaagcggatcatgaagagcgtaggtaacagtgatttttagaattgcttgcttaatccgctggataagaccagcttggtggattgcttcagtagtcgtattgctatatgcccggatgaggccacctgcgcccagcttaattccaccgaaataacgggtgaccaccgctacgacattatggatctttgctagtttaagtgattcaagaatcggaattcccgcagttccacttggctcgccattatcactttctcgttgaatttggtcattgtcaccaatcatatatgcgaagcaattatgagtagcttttttgttaactgcttggatgctggcgataaattgttgagcttcttcttctgaggagacacgagcaatcgagcaaataaatcgggattttttaattgtttgctcataagtggtgtttttagcaattgttaaatatggttctgtcatttttaaacttcctttgtgctattttgattaatttacgtatatataaagtaggaggtgaataatggatttagacaattattatgggcgacgagtcttagttccgcgtcatgagttgatacaatcaggaattcaagaactaccaacaattagaatcgatactgcgaatattagatgttatcgctgcaattatgtcacagaaaaatcgctaggtgctttgccacgaggtgagttttattgtccacattgcattaatcttggtcgtgtttcaacgttaaataaattttatcatgttccagagccaaatcaatttacggttaccgaaccggtgttgacctggaaaggaaaattatcgcctcttcagcaacaagcttcagaaaaaatttcccagggaatggctgatcatgttcagcaattgttatgggcagttacaggtgccgggaagactgagatgatgtttgcggggatcgctgcagcaattaaacgtggtgaaagaattggaatagcttctccacgagtagatgtctgtttagaattatttcctcgtttaaaagctgcttttgctaattgtgatattgctcttttgcatggtcgacaagaattaccttatcattatgcccaactgactatttgcacaactcatcaattgcttcgtttctatcatgcttttgataatttaattattgatgaagtagatgcctttccgtatgctgctaatgcttcgttattatatgcgactaagcaagcaataaaagagaacggagggtgtctttacttaactgcgaccccaggtgatgctttgctgcgagaaattaaaagtaaacgattagttgttaattatttgcctcttcgttatcatgggcatttacttccacaaataaaagttagactagcttttggatggcggcgacgtttagaaagacagcaattacccccgcaagttattcaacagttgcaggaaacgctaagggaaggccatcgctttttgctatttattcctcatattgcagatttagcattggttgaagctgcattacggcattcttttgcaactttccgctttgctactgttcatgcaagtgatccagaacgattagaaaaagttcaaaaaatgcgtgatggtgattacgactttttagtcacgacttctattcttgaacggggggttacttttccagaaattgatgtctatgttttgggtgctgatgatccagttttttcctcctcggcattagtgcaaattgctggtcgagctggacgtgcgcaaagtcggccaactggacgggttgttttttggattaattgtaattgtcgacaagttaatcaagctatttctcaggtgaagtacttgaatcggaaaggtcaaaggttgatagatggagtgtcttttgtgtaataaaagaatatctttccagctaagtttgaaagatatttttagctttcgcgaaattatcatgcctgtactatgtgctaaatgtaaggaaagttttgtgcgctgggatgatcacggatgtgcaggatgtggtagaaacaatactggtaaaaatagttccttatgtgcagactgtcagacttggaagaaactttacggttggtacttgcatcatcgaggattatatcggtataacgaggcgatgaaagaatatatgcaacgttataaatttaatggcgattatcgtttgcgagaggtgtttcagcgtgaacttagcaaagtggttaatgaacagaaagcagatttaattgtcccgattccagtaacgtcgacaacgatgcaaacgcgcggctttaatcaagttgttggtctactacgagaagtaccttaccaatcaatcttaggaactagggcaagttcaaaagtagcgcaatcaagcaagacaaaagaagaaagacttacaactaagcaaccatttatacttaaatctccagaagaagtaattaataaacggatccttttagttgatgatgtctatactacaggaaggacgttgtaccatgcagcagtactttttaaacaagccggctgtaaagagattggtagcgtttcactagcacgttaaattcttattaagatgcattaataaagtttgttaattaacacaaactaatctataataaaaataggatatgagaagagtggtccttctgatatcagatcaagcaattgcttggctgaaaggagagaagtacaatgttaaagttcaatattcgtggtgaaaatgtcgaagttactgagtcaattcgtgattacgttgtaaagcgaatcagcaagcttcaaaagttctttgaagatagtgttgaagctaccgcccacgtgaacttaaaagtttatccaaaccggacgtataaggttgaagtaacaattccacttccatacctaacgttgcgggcagaagagacttctaatgatatgtatggaagtattgacttagttactgataagcttgaacggcaaatccggaagtacaagacgaaggttaaccgtaagtcacgtgaaaagggtttaaagaaccttgaattcatcccatctgataatgatggaacagatggacaagatgatgaattaaagattgtacggacgaagcaagtttcattaaagccaatggatcctgaagaagctgtccttcaaatggatatgcttggacacaatttctttatcttccaagatgctgaaactaatggtacaagcattgtttaccgtcgtaatgatggtcgttatggcttgattgaagctgaatagtcaatgccaatatgaagagcgcggatgagaaatcattggcgctttttgtatcttataacttatagccaccttgtaatatccatactaataatttttatttataccatgaacgtggtaaaatattatggttagagtaaaaaaatataattggcttgagtagtacttttttattgattttggacttaagccagaaagtaggaaggacgcttttatggccaatattctaaaaaaatggattgaaagcgatcgtcgtgaattacggcgaattaacaaaatagcaaataaagtcgagagttatgctaaacaaatgtctgaactaactgatgaacagcttcaggcaaaaactgatgaatttcgggaacgttataaaaaaggtgaatccttggatcatatgttgccagaagcattcgcagtttctcgtgaaggtgctaagcgggtcttaggactatatccattccatgtccagatcatgggggggattgttctccacgaaggtaatattgcagaaatgcggactggtgaaggtaagacattaactgccacaatgccggtttaccttaatgcgatctcgggaaaaggtgttcatgttattactgttaacgaatacttgtcaaagcgtgatgctaccgaaatgggacagctttataattggcttggatgttctgttggtattaacaactcagagatgagccctgatcaaaaacgagaagcatataaagctgatattatgtattccactaatagtgaaattggatttgattaccttcgtgataacatggccgtttacaaagaagaccaagtccaacgtgggttaaactatgctttagttgatgaggtggattcaattttaattgatgaagcgcgaacaccgttaatcatttcaggaccaggaacgggaacttctaagttatacaaacagactgatcggtttgttaagcagttaaagaaagatgttgattacaagattgatcttgaatcaaagacagtttcattaactgatgaaggaattaaaaaagctgaaaaatacttcaacctaaagaacctatatgatccagaaaatactgcgttgacccaccacttggatcaggctttgcgtgctaactatatcatgcttttagataaggattatgtggttcaagatggtgaagtattaattgttgactcctttactggacgtgtaatggaaggtcggcgtttctctgatggcctgcaccaagctattgaagccaaagaaggcgtagaaattcaagaagaaaacaagacaatggctaacattacataccagaacttattccggatgtataacaaactggcggggatgactggtactgctaaaactgaacaagaagaattccgtgaaatttacaacatggaaactattactatccccactaaccgtcccgttcagcggaaagacgagcctgacttgctttatccaacattacaaagtaagtttgcagctgttgtcgatcggattaagaaacttcatgctaaagggcaaccaattttagttgggacagttgctgttgaaacttctgaatacctatctcaacttcttgataaagagaacattccgcatgttgttttaaacgctaagaatcacgctaaggaagcggaaattgttaaaaatgctggtcaaaaaggtgcagtaactatcgctaccaacatggctgggcgggggacagatattaagttaggccctggagtacgtgaaattggtggacttgcggttattggtactgaacgacatgaatcacggcggattgataatcagcttcgtggacgttctggacggcaaggtgatcctggtctatcacaattctacctatcgcttgaagatgatttgatgaagcgatttggtggggaccggatcaaagccttcttagaacggatgaaggttaatgatgaagatgctgtcattaaaagtcgtttcttaactcaccaggttgaatcagctcaaaagcgggttgaaggtaacaactacgattcacggaagaacgttcttcaatatgatgatgttatgcgtgaacaacgtgaaatcatctataaagagcggcaacaaattatcactgaagataagtcgctgaagtgggtccttatgccaatgtttagacggacaatccagcgtgaagttgatcaacatacccttggtgacaagaaggattgggatttacaaggaattgttgactttgcagaagaagtcttaatcaagcctgataccatcacagttaaggatctagaaggtaaatcacctcaagaaatggtggattacttgatgacatttgcccagggagtttataaggaaaagcaaaaacaactttatgatccagcacaaatgcttgaatttgaaaaggttgttattttgcgggtagttgactcacactggactgatcatattgacatcatggatcaattccggcagtcagttggcttacgtggatatggacaattaaatccattggttgaatatcaaactgctggttatcacatgtttgaacaaatgattgctgatattgagtacgaaactactcgactcttcatgaagtcagaaattcggcaaaatgtaacacgttaattgttaattactactaggtacggcagtaaggtaacccatggcggtaccgctgccgtattgttgtataacggaggttcgattgtggaattaaatgaagcaaaaaaacaagtagaatcaatgcaaaaagaagttacgcacttcgggaggtctctttgacttagatgcactagatgagcgcattgcagaaattgaacaggaaatggctcaaccagacttttggaatgataatgagcaggcacagaaggttattgcggaaaataatattttaaaagagaaacgggatacttttgtgaatttacgtgatcagattggcgatcttgaaacgtcgcttgaattactcgcggtcgaaccggacgatgatttacaaaaagagttcgaagcatcatttacaaatacacaaaaggccttagaacagtatcggttgacccaacttcttgatggggaatacgacgctaaaaatgctattttagaaattcatcccggagcgggcggcactgaggcccaagattggggtgaaatgcttctgcggatgtatgttcgttggggtgaacagcatggcttctctgttgaaacagcaagttatgaagccggtgatgaagctggtatcaagagtgttacgctgctaattaaagggcataatgcgtttggttaccttcgcagtgaaaagggagtccatcggcttgttcgtatttccccatttgatgcggctggtcggcgtcatacatcatttgcttcggttgacgtaatgccagagttggatgatagtgttgaggttgatattgatccatcagatttacgagttgatactttccggtctagtggtgctggtggtcagcatattaataaaacggaatctgctgttcggattacgcatattccaaccgggattgtaacctcttctcaagctgaacgatcccaactccaaaaccgagtgactgcaatgaatatgttaaaatcaaagttatatgaactggaagaagaaaagaaagcgaaaaaacgggcggaaattgagggtgaacaacttgatattggttggggttctcaaattcgttcatatgtttttcacccatacaccctagtcaaggataatcgaacgggttatgaaacccataatgggcaagctgtaatggacggggaccttgatccatttattgatgctttcctccagtggaaacttagtcaaaagaatcctcaataagttatttggtttggaaggaagtgagtaaagtgcgcgaaagtcaacataaaagattaactcgctcaggatcagatcgaatgatagctggtgtatttggcggaattggccagtactttaagattcagccaaatattttacggattttatatgtcttactgactatttttaccggttttgttccaggtattattatctatattattttgataataataatgcctgctgatccacaaaatcccgatttactaggatttttaaagtccttcagtgaatcacaaaaaacatctcaacagcctcaccaacgttctcggcggactttaacgaatgtcgaggaaaaagacattaaaagaaatggaagatcatgatggaattttggaaacgagtattgattgatacaatcctttttattgcccttgctggtttatttgccggaacagggatgttttatatcacaagtgcttggattgcaccattggcaagctttgtgttagcaattttgaacgttgctattaagccaattttagtaattttatcgttgccgattaatattttgaccctgggcctttttagtgttgtaattaatggaattatgctacaactaacatcgatgcttgtcgggtcggcaaactttcatttttcgtcatttggttctgcaatgttgattgcgattattatggcaattttcaatgcagttatcacaagtcacgaggatagattgtaaaggagtggagaaaaatgccaaacaatgtaacggtgcaagaattagttgataaggtccggttaaaagtcttgcaaggagaagattacctccaacgtaagataacaaccagtgatatttcacggccggctcttgaattcgcggggtatttcaagcattatccagcagcacggattcaattgttaggaatcacggaaacctcatttgctaaagacttaactcatgagcaacgtgaggagtacatgacaaaaatgtgtatgccacaaacgccatgttttgttatctcaactaatctgccaattcctaaggagctaaagaaggcggcggaagatgcaaaaattccaatcttaggaacgcatttaacctcttctcaaatattaagtaacatgacttcttacttgcttgaacgtttggcaccacgaaagtctctccacggtgtattagttgatatcagtggggttggagtgctcattactggtgattcgggagtgggtaagagtgagaccgcgttggaacttgtgcgtcgtggacaccgactgattgctgatgatcgggtagaagtttacgcccgtgacgaacagactttggtagggactgctccgcaaattttaaaacacttaatggaaattcgtggaattggaattattgatgtctctacgctctatggaacaggggcaattatgccttctgatcaaattagtttaattgttcaccttgaaacgtggactccggatgtacaatttgatcgtcttggtgaccgtggagatactcaaacaattcaaggtgtcattgtgcctaaagtctctgtgccggtaaaaactggtcgtaatttagcaattattattgaatcagctgcaatgaattatcgggctgagacaatgggctatgatgcgactgaaacatttgatcgaaaccttaaccagttgattaagcagaattcggaacgtgatagtaagaataataaggggtcggcaaactagatgattaatcaaggaataaaagccgctttaaacccaatcgctttccaaggtggtccgtttactatccactggtatggcgtcattattgctagcggggtagttttggctcttttgttagccgttcgtgaaggaaagcgagaggggattcctgaagatgatttttatgattatcttctatgggcgcttccgattgcgataatttgcgcacggatttactatgtcgtatttcagtggagctactactcccagcatccaagtgagattattgctatctgggatggtggaattgcgatatatggagcgattttaggaggctttattgttttacttgtcttttgccattaccgccatttatctagctggctgatgatggacatcattgccccaacccttattatggctcaaggaattggccggtggggtaactttatgaatcaagaggcatttggtgatattacgacacgggcgcatttaatggctcagcatattccaaattggataataaaccaaatgtatatcggtggtcactatcgaattccaacgttcttatacgagtcattatgggatttaaccggttttgcattattaatgttacttcgccatcgcaaacatctatttcgtcgcggtgaaattttcttaacttatgtaatgtggtatgcgtttggccgcttctttattgaaggaatgcggaccgatagtttaatgcttggaagtattcgcatttcacaattactttcgatagtgttttttgtcagtgcattaataatactaataattcgacgtcataaaaatattccgtggtattataacggaataaacaaaaattaattgaattagagaaggagaaaaaattatggcagaaaaaattgctgttttaggtgctggttcgtggggcagtgttttagcaaacatgcttacagaaaatggccacgatgtaacattatggtctcgtaatgaggaacaagttaagcaattaaatactgaacatacaaatcctcgctatatgaaagattttgtttattctactaacttaacagcaacaacggacatgaaaaaagctgttaagggtgccagtgtggtcctgattgtaattccaacaaagggtcttcgtgaagttgctaagcaattaaatgcaattttgactgaattacatcaaaaaccgctagttattcacgcaacgaaaggcttagaacaaaatacttataagcggccatcggaaatgcttagcgaagatatttctcctgaaaaccgtcaggcaattgttgttttatcaggtccgagtcatgctgaagatgtggcgattaaagatatgacagctgtaaccgcagcttgtgaggacctggccagtgctaaaaaggcgcagaagttatttagtaattcttatttccgtgtgtacactaatgacgatgtaattggtgccgaatttggcgcagccttaaagaacattattgcaattggtgctggagctattcagggacttggttatcatgataatgctcgggcagcgttaattactcgtggacttgcagaaattcgccgattgggagttgcttttggtgccaacccgatgacttttattggtctttctggggttggtgaccttgttgttactgctaccagtaaaaattctcgaaattggcgtgctggctatcaattggggcaaggaaaaaagcttcaagatgtaattgataatatgggaatggttatcgaaggtgtctatactaccaaagccgcttatgaattaagtcgtaaacgacaagtacagatgccaattaccgaagctctttaccgtgttttgtatgaaggcgaagatattaaaactgcaatttctcaattaatggaccgagatcttacttcagaaaacgaataaatatggtaaaatgctagaggatggatattgagagaaattgaaacatggaaagggttttataagtatgaaacgtgttagaaaagccattattcctgctgccggtttaggaactcgttttcttcctgcaacaaaggcattggcaaaggaaatgttaccaattgttgataagccaacaattcaatttattgttgaagaagcgcgcaaatcaggaattgaagatattgttgttgttgatggaaagaataagcggtcgattgaagaccattttgactctaatccagagttggaagataatcttcgttcaaaacacaaggatgagatgttaaagatggttgaagaaacaaccgatgttaatatttacttcattcgtcaatctcatcctcgtggtttaggggacgctgttttaactgctcgtgattttatcggggatgaaccatttgttgttatgcttggggatgaccttaataacattaacaacaagaatgaagctttaacaaagcaattgattgaaagttataaccaaactggcgcatctactcttgctgttatgcgggttccacatgaagatactgcaaagtatggtgtaattaatcctagcaaggaagttacgccaggtctctataacgtaactagcttcgttgaaaagccagctcctaaagatgccccaagtgatttagcaattattggtcggtatgtctttactccagaaatctttgacgtattggcaaagactaagccaggtaagggcggcgaaattcaattaactgatgcaattgatactctgaaccaaactcaacgggtattcgctcgtgaatacaagggtgaccgttacgatgttggtaataagtttggctgggttaagacaaacattgaatatggtttggaacacccacaagttaaagaagaattgcgtgaatacattaaggaattaggcgcaaaacttgctgctgaagataagcaaaataattctaagaagtaagactagcattagccttttaacaaaattaaaccttcaagattcgttatagggatcttgaaggtttattttttttacatatcttcaacaacgacatattccatatcaagtggaccgtgaacaccaacgattagtaccatttcaatatcaccagaattagatgggccggtaataaagttgatgtttgatgtttgtaaactaccatcctgaattgctttttgataataatccattgcttgccgtgaacgtggtaaaattttgctttttggcacaatagctaggtaatgggttggaagaaaatggaacatccgtccttgttgtgggtaggttgcaacggttacggtccctgactcggctaatagaaagtccgcaaagccaattgccccatcactgttatttgcatttacaatgttttgccgcccaaattcaggctcccaatagtaaataggatctactcgcaaattatcctgccatttccccaatgaataatcttgccacttctcttcatcaaaggagggaagcattaaacttttaatctctttttcttggataaaatcattgagagtgtggccaagatcggctgatttaacaacatggaaatcaacatgaacttcttcgctatttttgcgtgcgagttcaagaagttcatcttgactttttccagcaagggtagtttctggaagatcattaacggggacaaatggatcttcaccaagcgtatggcgaggacggttggcagcctttgcaattcgatttaagaagtcttcttgatttttagcagtgtctgcttcttgtaagtaatcagtcatttttctgctcctcctcttcttcgtaatgacgataccaatgccggaagttttgatgatacttcggcggaacagcgagatcacgaacgtctacccagccatgagctagtttaggagcaattgcgggaaggtggttaattttaccatctggataaaggttcttaatgtcttcaggagttgttttcttgccaaatggctcaagagcaatatgagcaaatcgcattgcatcattaaaaagcgtaggggagctggtacctttaccaactgccttcaaaagagcatttgaaggactgtgatctaaatgaagctcatcaatttctacataacggtgatgacggattaactcatgaagaggaattttaacaggacaagtttccgtgcaagcagcacataaactacatgcatatggcaattccttgaattcttgataaccgcctaaaatcggtgaaagaacttcacccattggtccaggataaatcgatccatagccctttccaccgacttgtcggtaaacggggcaaacgtttaagcaagaaccacaacgaatacattgcagcattggttcaaaatcagaattcagcatcttggaacgaccattatcaacaatgacaacatagaagtcgtctggtccatcggcttcatctgcttccttacctttcgaaaaagtacagtaactagttagtttttgaccaactgcacttcgacataaaacattgtcgaggacttctgcttcttttaagcttggtacaattcgttccatccccatgactacaacctgggttttaggaattgccatacttatatcagcatttccttcgtttgtgaccaagttaatcatcccgttatcagcaatcgcaaaattacagccagtaatgccaaaatcagcttgcataaagtaattgcggagatagtggcggacaaatcttgccatgtgttcagggtcgttatcaccatcataaccgagtttttcaaaaactttttgaatttggttgcggtttttatgcaatgtagggaaaacaatatgagttggttcatcccagttatcttcctgtaaaataaactcggctaaatcggtttccattaatgaaaggccagggatagtcaatagttctttatcaaggccaatttctgtagtgaccattgactttgatttaacaacgtgatgagcttgctttttgattgctaattgtttaataaaggcacttgcttcgtcaccatccttggcaaagaaaacatgaccaccatttttttgaacgttgtcactgaattcttccaagtaatccggaaggtgcttaataacatgttgacgaatttcggcagagagatcacgccaaccttcccaatgacctaactggcggcgcgcttctgttcgtttttggaattgagcgtcttgtgctttagcaaccgatgcccgcataaatttatcggcttccgcgtccttgattcgttccgtaaaaggcttatcgcttgtggctattcccatctaaaacaccccgtttccgtttgctggtaccattacatgatccgtatctttgacataagtgatccggctagtgtcaacgttatgattaaggacctcagcaatgtgcataattgtaatgtgagagccatcccggcgacggttaattcgtccaccaatattcattaaacatgtttgctcacaagcaataagaatatgtgcttttgtcttcaaaacattatttgctttatcatcgaccatcgcttcagagagaaggggttctttagcagagaatgttccaccaaagccacaacataattgaatgttatgaagggggatgagttcgagacccttgacgtgttcaagaagaacaattggtgccgtgcgttcaccaagaagacgagtcatgtgacaagaacggtgaaaggttgccgtatcatctaggtctgcaccacaatcaagaataccgagaacccggtaaataaattgcgttagttcaaaagatttatcataaagggcttgtgctttcttcgaatactctggatcatctttgaaaatgttcttgtattcatgaagcatggcaacacatgatccggaaggcccaacaatataatcggcgtcaatacttaaaagggcatcgagttgatttttaaatgtagcaattgtttcacgatcataaccgctattataagttggttgtccgcagcaaatttgtttatcggggaaaaaggtttcgcagccaaaacgttggagaagttcaaccgttgcctttccgacatctggataaagcagatcaacaatacaggtagaaaaaatacagactttcatacatgcgtgcattaattggatgcacttcgcctccttaaaaatcgaaaaaatataattgcttatcataataagtataactcaaatatgataaaattaggtttgaaaacgatttaattgattaaatattctatataaaattataatattagttatagttcgataaagaatatcactgataaaaagtaagctaaacgatagacaaaaagatccaaagtcggtatgatatggatagtaaaaaaattattcgaggaggaagagagaaatggctgaaagtaagcaatatgatgttgtaatcattggtgccggccctggtggaatgaccgcagcaatgtatgcctcacgtgcaaacctatctgtcttgatgcttgatcgtggaatttacggcggaaacttgaataatactgctgaaattgaaaattatacaggatttaagagtgttaagggtcctgaacttgcccaacagatgtatgaaggtgcaactcaatttggcgcagaatatgcttatggaacagtaaccaaagtggaacttgatggtgacttaaagaagatcactactgatatggatgaaacatatactgcaaaggcggttgtaattgcgactggatctgatcagcggcacctcaatgtccctggagaagaagaatttggtggccgtggtgtttcatactgtgcagtttgtgatggagctttctttaagggaaagcatttaatcgttgttggcggtggtgatgcggctgttgaagagggggtttacttaacgcaattggcttccaaagtaacagtgcttgttcgtcgtgatgagctccgggctgaaccaattattcaagcagaagcgatgaataatgacaagattgagtttgtttacaacactagtgtgactgaaattgttggggatgatattaaagtaacgggtgttaaaactcataataataagactggtgaagatggtgaaatggctgcagatggcgtcttcatttatgttggcaatttcccaatgaccgctgcttttaagaatttagatattctagatgatcaaggctgggtaaagactgatgagcgaatgcggacggcagtaccaggtatttttgccattggggacgttcgtgaaacaccattacgacaggttgcaacagctgttggtgatggtgcaattgctggacagcaagtttaccaatacattaaatcgatggcttaataaaaaggatgttagagaaaagctctagcatctttttttgtttagtgttatagttttgattaaaaaataattagaaaaggagggcgattactattggaaaatgatgaaaaggtaaagctattacagaagttgatccagataaatactgtaaatggtaatgaagaagacgaagctaattatattaaaagggtcttagaagctcatcatatttcttgcaaactagtttcctttgcaccaaatcgaaccaatttaattgcagagattggtaatgataaggggccggtactcgccctagctggacacttggatactgttgatccaagtgatccgcaaaaatggacatacccgccattcgctggccaattagtagaccgtaaaatctatggtcggggtgcagttgatatgaagtccgggttggcagccatggtgggtgctttaattgagcttcaagaagcagatttgccaaaacatgggaaagttcgcctgattgccactgttgatgaagaagttggaggaaagggttcgcttgaacttactgatcaaggatacgtacacgatgttgacgcaatgatcattggggaagctaccactggtcaaatcgagtatgcccactgtggctcctttgattatattgttgaatctcatgggaaattagctcatagttcacaaccagaattaggggcaaatgctgttacaaatctagtgaaatttatcaataaagaatcacgggcatttgacgatgcagcagtaagtcccaccctaggaaaattaattcatagtgtgactgtctttcatggtggagagcagttaaactcaattcctgattttgcatacttaaaaggaaatgttcgcacgattccagaatgtgataatgtggagacgcaaaaaagattacaggatattattgatgggttaaacaagaaacctaaaattcaattgaagttaaaagttgttgccagttttatgccagtggttacaaataagcaagatcgcttcattgcccttgctcaaacggcaattaaaaaggttagcggcaggcaaccggatgtagtgatttctcatggggcaacggatgcatcccgctatgttttagacaatcacaactttccaataattgaatacggaccagggattgaaaagttatcacaccaaattgatgaacgtattgcgcttgatgattatttaacggctcagcaagcttatgttgaaattgctaaacaatatttgaataatactaaagacgatgaacaggctagtagttaagcatgaccgtacagagactccggctgatggaaaaggagcttttatgctaatgaatcacacctgggagtaaagattttttgattgaaagaagaatccgggagtcacccgttatcacaaagagtttcgtcgcaaatgactgaacttaatgaggcagttgctgtgaggtagctgtgaaaaaaggtggcaccacgcatactaaatacgtcctttgaagatttattcttcaaggggcgttttttgataaaggagaagataagtatgaagaaaaagataattaatttcgaattagttttaatattgcttttacctttaattgtttttacaagtggctttaagattcaaaatgagaattaccgggcgaaccacactgatacgtgggaaagaataaagaagcggggaacattacttatcggggttgatgatacttttgttccaatggattttcggaagaagaatggtcaactggttggttatgatgttgatttatcccgcgcagttgcgaaagttttaggattgaaagctgattttcagtcaattgattggtcaatgaaggaaaccgaattaaaaaatggcacaattgattgtatttggaacggctatacagctactccttcccgacaaaaacgaattgcatttagtcgggtttatgaactctctgggcaatcattagtggtgcggaaaaatagtaaaattaaaaatttcaaggatatgaaaggaaaggtattaggaattcaagaaagttcaaccgctcaaactgattttgacaaatatcctcaagtattgaagaggctagttaaaggacaaaagccaattctttatcaagataactcaagtgctttcatggatctgcaagcaggccgaacacaaggagtacttgccgggactgtctatgccggctattatgcgactcacattgcaaataataataattataaattgatttcagcatctgcttatcctgcagaccgagttgcaattggaatgaggaagggggaccggacgcttattaataaaattaactatgctcttggggttcttcaaaaagatggtaccttacgacggattaataaaaaatggctaggaattaatagtaattatctgggaccggttgctgaatttcaaaaatccaacaataatcgttaatgatttgttaaaattttatataacaaggactaaggaggttttttaatgggtgcaatcaaatgtaatgatacattagcggtgtcaattcatcggattcgtaattcagatttaaacgagcacgggacagtatacgggggacgaatcttagaattgattgatggtcaagcctcggtagcagcaatgcgagtagctcgaacaacagttgcaacagtgtcaatggatgagatccaatttctgcgaccatttgaccttcaagattcaatgtgtatggaggcatatgttactggctttgggaagcggtcaattgaagtgtttacaaaagtaattggcgagcacttgatgaccggtgaacgtttcctcggcttttattgttttatgacttttgtaattcttgatcctgaaaaacaaacggcatttaataaattaattccagaaactgaagagcaaaagacgttaatggcaacatattctcaacgtgttaagcaacggcaaaaccagcggcaaaaacagcaagaatttctgcctcatatttcaatttccaagccgtggtaaaactttagtaaatttttaagtgaaaagcgacagatagcattttatgcggtatactaaaaagcagagtatgacataaaggagacattattgtgagctggaaagatacttataaggtttggcaagaacgaacagatcttgaaccagacttaaagcaagaattagctgcaatgagcgacgataaagaaattgaggatgccttttacggtccactatcattcggaactgcaggaatgcggggactaatgggaccaggaattaaccggatgaatgtttacactgtccgtcaagcgactgaaggtttggcaactttaatggattcattgggtgatgatattaaaaaacgaggagtcgctattggttacgattctcggcacaactcccgtaaatttgctcatgatgctgctcgtgtattaggtgctcatgggattaaggtttatatctatgataatttacgcccaacgcctgaattgtcatttgcagttcgtcacatgggaacttatgcagggatcatgattaccgctagtcataaccctaaggaatacaatggttacaagatttacggtgaagatggcggacagatgccacctaaagaatctgacatgatgacaggttacatccgtaagattgatgatatttttgacattgctttagctgatgaacaagaaatgcttgacaatggtttggaaacaatcatgggcgaagatgtcgatgctgcataccttgctaatgctaaaggagtaactgttaaccctgaattagctaaggaatacggtaaagatatgaagtttgtctttaccccattatgcggaactggccgaatgcttggtgaacgggcattacgtcaagctggttttacaaattatgaaatggaaccaactgaagcacaaccaaatggtgacttccctggtttggaacatcctaatccagaattcccagaagcatttgttcgttccattgcccttggtaaaaaggttggtgcagacgtattgatcgccacggacccggatgctgaccggcttggatgtgcagttcgtcaaccagacggtgaatatcaattgctaactggtaatcaaattgcttcaatcatgcttgcctacattcttgaggcgcataaacaagcaggaaccttaccaaagaatgctgctgcggtaaaatcaattgtttctactaacttcgctgctaagattgcagaaagctacggcgttgatatgatcaacgttttaactggtttcaagtggattgctgatcaaattcatcaatatgaaactggcaaagctgatcatacctttatgttcggttttgaggaaagctatggttaccttattaagccatttgttcgtgacaaggatgctattcaatccttaacgttacttgctgaggttgccgcttattaccgtagtcgtaacatgaccctttacgatggcttacaagaattatttaagaagtatggctacttccgcgaaaagacaattgctaatacctatgcaggtgttgatggtccagctaagattaaggctttaatgaagaaattcagagaagaagctccaactcattttgccggtcatcaagtagtagttactgaagacttcgctaatgggactaaaactacagctgatggcgaagtaagtgaattaggtattccagaatcaaatgtattgcgttacattcttgatgatgatacttggattgctattcgtccatcgggaactgaaccaaagcttaagttctacattggtacaagtgctgataccttggataaagcaaatgaaaaattagctgatttcgaaaaagctttacaagagtttgctgaataataataactgagagactgttgaaaaaactttgctttttcaacagtctctgtttttatatccaatattgtggatgtcgataagactaaatttcccctcacctttcttgaaatttcgtcaaaaaattgtatgattgtacaaattaattagtttttgggaggaattcatcatgggaatgcatgaatatctaaaaagtttaagtgaccttgaaatgattaaccgtgctccaggatattttaaatttgaggaacacaatgtggctgcccattcatttaaggtaacgcaagcagcccaaatgcttggtgatattgaagagcaagccggaaatgaaattgattggcgttctttatatgaaaaagctcttaatcatgactatacagagcgttttattggtgacattaaaacgccggtaaagtatgctactcctgaattgcgctcaatgctggcgcgggttgataaatcattaacagaaaactttattcaatctgaaattccggctgagttccgggcagcttatgaacggcgatttgcggaaggtaaagatgatactttagaaggtaaaatcctcgcagttgctgataagattgatcttatgtatgaatcatttggtgagattcaaaaaggtaatcctgaaccagtttatatggatatttataagtcgagcttgacagcaattatggattttcgtgatatggctagtgtccagtattttcttaagaagattttgccagaattattaaaagataatgcagatggtaatgcgaaaaaccaattagcgattattactacccaaattattcaacaataatctatattttaggtgtctctttaccaaatagttgatttttgcaaacgctttcttataatagaagtagaaggtaaaaactaacaaggtaaagggaggcggcaaggatgacaccaagtttatttgcaggaacatttgcaattttagtattatggttaatcgttgatattatctgggaattgagtcgaccaagagacattgtaatgcggcgcctttgtgcttggcttaatcttattgcgattattggtggtttttccgtattttatggagtaacccattttgataatgctaatcttgttccatggtttatttgtttgaattggattaatgttgttgccgcgggtttacaattttactttggttactttcggcatagttaaatgacaaataaaatattttaagaagtgagtgaaaatggtcttgtttggagagattattttccactcacttttttactgtaaatttatagacgaatacatgtttgggtgataaactaataacagtaaataataaatagttagtgataagtgggatgcggtaatttatgaagttgcgattccactttattttatttaactgcgacgtaagggaggaaattcttttgatttaccggcaaccagataaaaaatttgaactagtgtcagagtacaagccaaccggcgaccagccccaagcaattaatcaattgacaaaggggattgaagatggtgaaaaagctcaaatcttattaggggcaacgggaactggaaaaacatttacgatctcaaatgtgattgctaatgtcaataagccaactttgattctttcccataataagaccttagctgggcaactctatggtgaaatgaaaaaattcttccctcataacgcggttgaatattttgtttcctactatgactactatcaaccggaagcatatgttccatcaagcgatacttatattgaaaaagatgcgtcaattaatgatgagattgataagctgcggcactctgccaccacttccttgttggaacgaaatgatgtaattgtcgttgcctctgtttctagtatttttggattaggggatcctcgcgaataccaaaatagcgtcctttctttgcgtgttggtcaagagattgaacgtgatcgattgttgaccgaactggttaatattcaattcgatcgcaatgatattgattttcaacggggacgtttccgcgttcgtggtgatgtagttgaaatctttccggcgtcgcgtgatgaacgggcattgcgggttgaattcttcggggatgaaattgaccggattcgtgaagttgatgcgctgacaggcgaagtgattggtgaccgggaccatgtttctatcttcccggcgactcactttatgactaatgaagaagtcatggatcgggcattgccacaaattgaagctgatatgaagaaacaggtaaagaagtttactgatgagggaaaacttcttgaagcagagcggattcagcaacggacaacttatgatattgaaatgatgcgtgagatgggctacaccaatggaatcgagaattattcgcgttacatggatggtcgaaagcccggcgaacctccctatactttattagatttcttccctaaagatttcttattagttgttgatgagtcccaccaaactatgccgcaagtacggggaatgtataatggggaccgggcgcggaaacaaatgttaattgattatgggttccgcttaccgagtgcgcttgataatcgaccattaaaactaccagaatttgaacaacatgttaatcaagttgtatatatgtctgcaactcctggcccatatgaaatggaacagacagaccacgttgctcagcaaattattcgaccgactgggttgcttgacccaacagtcgaagttcgcccagtaatgggacagattgatgacctagttggtgaaattaacaaacggattgagaaaaatgaacgtgtttttgttacgaccttgacgaaaaagatgtccgaagaccttacggattatctaaaggatatggggttaaaggtcaaataccttcatagtgatattaagactcttgaacggacgcaaatcattcgtgatctccgtcttggcaaatttgatgttcttgttgggattaacctcttgcgggaaggcctagatgttccagaagtatccttggtcgccattcttgatgccgataaggaaggctttttacgtaatgaacgttcccttattcagacgattggtcgcgcggcccggaatgagaatggggcagtaattatgtatgctgataccgtgactgactcgatgcaaaaggcaatggatgaaacaaagcggcgacggacgattcagatgaaatacaatgaagaacatcacattacgccgcatacaatcatcaagccaattcaagaagcaattactgttactaagaaagcgacggatgaaactgaagcagataacagcgctgaatttactgacaaagattttgcaaagttggataaagaggcccaagcaaagatgcttgatgaattaacagagcaaatgcgctctgctgctaaacgccttgactttgaacaggctgctacgcttcgtgatacgataatggaattaaagacaaaagcaaaaaaatagaggagggattatttcgtggcaaatgataagatcataattcatggggcacgggctcataacctaaaaaacattgatattactattccgaaaaacaagttagtcgttgtaactggtctgtcgggttctggaaagagttctttagcttttgatacattatacgcagagggacaacgacgctacgtggaaagcttatcggcttatgcgcggcaatttttaggccagatggataagccagatgtagattcaattgacgggttatctccagcaatttcaattgaccaaaaaacaacatcccataatccgcgttcaacggtcggaaccgtgactgaaattaacgattttctccgcttgctatgggcacgggttggtacaccaatttgtccgaacgataatattccaattactagtcagtcaccagaacaaatggtggatcgggtactagagttgcctgaacggacacgcctgcaaattctttcaccagttgttcgcgataaaaagggaacacaaaagaaagtctttgagacaattaagcgtgaaggatttgtccgggttcaagtagatggcgaaacttatgaccttgattcagtccctgaactagataaaaataaaaaacatacagttaatgtcgtgattgatcgaattatcatcaaagagggaattaggtcgcggctatttgactcctttgaatcggctctccgcttaagcgatggttatgcaattgctgatgtgattgggggagacccaattccattttctgaacaatatgcttgtccaatttgtggctttacagttggtgaattagagccacggttattttcctttaatgctcctactggtgcttgtccagaatgtgaagggttaggattgaagctcgaagtagatattgatttagtagttcctgaccaaacaaagaccttaaaagaaggggcaattgttccctggaatccaatctcatcgcaatactatccacaaatgttggaacaattctgcaagtcggttggtattgatatggatacgccgttcaataagttgtctaaaaagcaacaacaacagattttgtacggtaatggtgaaataccattccacttccattatgagaatgactttgggggcattcgggatgtcgatgtgccatttgaaggtgttatcaataatattagccgacgttaccgggagactaactcagattttacaagagaacaaatgagaaaatatatgactgagcttccgtgtccggtttgtcatggttatcggctaaaccagcgggccttagcagtaaagattgatgggcgaaatatcggtgaagtttccgctttatcaattagcgattctcttgaattcttcaagaacattaaactttctgcacaaaaaaatgaaattgctaagccgattttaaaagaaatcattgatcgattaacctttatgaaaaatgttggtgttgaatacctaactttaagtcgttcagcccgaactctttcagggggagaagctcagcggattcggttagcaacccaaattggttctaatttatcaggagtaatgtatgttcttgatgagccgtcaattggacttcatcaacgagataatgaccgtttgattgaatcgttaaaggccatgcgcgatctcggcaatacgctgattgtcgtagagcatgatgaagatacaatgcgcgcggctgattacattgtcgatattggccctggagctggtgaaaacggaggccaagtgatggctgccggaactcctaagcaagttatgcgatcacggaagtcgttaactggccaatacttatcaggaaagaaatttattccggttcctcaagagcgcagaataggtaacggtaagaaaattactattacaggagccgcagaaaataacttaaaggatattacagttgattttccgcttggtgagtttatttgcgtaacgggtgtttctggttcaggaaagtcaactcttgttaatatgatcctcaaaagggttttggcacaaaaactgaataataattcagcaaagcctggcaagtacaagtcgattagtggagttgaaaatattgagaaagttattaatattgatcaatcgccaattggtcgtactccacgaagcaaccctgcaacttatacgggagtctttgatgacattcgtgaattatttgcccaaaccaaccaagctaaaatgcgtgggtatactaaggggcgttttagctttaacgttaagggtgggcgctgtgaagcctgccgtggagacggaattattaaaatcgagatgaacttcttgccagatgtttatgtgccatgtgaagtttgtcatggaacacgttataattctgaaacgcttgaagtggaatacaaaggcaagaatattgctgaggttcttaatatgactgtttcggaagccctggacttctttagcgcaatccctaaaattaaacgtaaattgcaaaccattgaagatgttgggcttggctatgttcaccttggtcaaccagcaactactctttcaggtggggaagctcaacgaatgaaattagcagctgaacttcaccgtcagtctcacggtaagagcttctatattttagatgagccaactactggattgcacatggatgatatcaaacgcttattagctgtcctgcagcggttagtcgatgcgggaaatactgttttagtaattgagcatgatttagatgttgtaaaatcagcggactggttaattgaccttggccctgaaggaggagctggtggaggtaatgttgtcgccactggaacgccagagcaagtagcggaagtaaagggaagctatactggtaaatatttaaaagagatgctcgaacgagatcaaaagtgggcagaagaacgagaagctaagcaaaaaaagtagttgcaatctaattcttctaatggtattctaataaaaatcaaagtacacgaaacgagggaaaagaaatgttattttttaataatcaaaatcaacagttttcttcctcctcagcctctaactctattaaggctgagtgattttggtgtacccaatcaataggtttatacagactcgggttctctattaatcatttggcgtgaccaaattgcattaataggtgatatcccgggtttttattttgcctaatattaagaatggaggaatgatgatgaatcaacagccaacagatgaattaaaaaggtcgcttggattctggtccgctatttcgattgttattgggacaattattggatcgggaatattctttaaacaaggatctgttcttgatagtgctggtacatctactcttgcaatagcagcctgggtatttggaggaattattactttaactggtggattaacagtggcggaaattggtgcccaaatgccatatactgggggactatatgtctatattgaaaacttgtatggccgccttttaggatttttagccgggtggatgcaagtaattgtttatgggccagcaattattgcttcggttgccggatttatgagtattttaatggcaaacttctttggtttaggaacccagtggcggatacctttagcagtgattacagtgattgccattggcgtaatgaacctttttgaaaataaagttggcgcaattttttcgattatcacgactgctggaaaaatgattccaattgcggcaattattatctttggtttgttctgggggcatcaagatgcttttggtcaaacggttaccgaaattcaccaatcaactggtgggtttggggtagcagttttagcaaccttatttggttatgatggttggattttaatcgcaaaccttgggggagaaatgaaaaatccccaaaaattattgccacgagctattattttagggattactgctgttcttattatttatactttaattactgttgggattttgaagttccttccagttaacactattcatcggctaggcgaaaatgcaactgcatacttagcagtgaaagcttttggagcaattggaggaaaactgctgtcagccggaattattatttcgatgatggggactttaaacgggaaaatgattacttttccccggattgtatacgcaatggcgcgtcgtcatgatttgccattctcacgctatctcgcatatatcacgccaaagggtaagtcaccagtagtcgcaacgatgtttattatcattcttgcaacgattatgatgttcttctttgaccctgatcacttgtcagatttgtgtgtgtttactgtttattgtttctatcttttagcattctttgggatcttcattttaagacataagaataagggaccgcgcccatttagcacaccgctttaccccttagtgccaattattgcaattgctggtggaatctttgtcctcgtaagtgaagttatgaatgatccagctggtgtaattctttttatcggaatcgtcattgtaggattgccaatcttatatattgttaaacgaatggatcaacgacggatgcattaatatttaaggctgagtttgacttggccttttttgttgctcaaataagacacacccggcctgatgtgataaaatagttgggtagctgtatgcgaaaagaggaactagtgatggtagataaaaaattaaaagtagtaattattacagggatgagtggtgcggggaaaaccgttgccgttcatagcttagaagatttaggatatttcgtaattgataacatgcttcctggattggcagaacgttttgttgatgtgatagaagattcgagagagtttgataaaatcgccatggtaatggatatgcgttcacgcggattttacgatgaggttttaccaaactttgaaaaactgaaaaaacgagctgatttagatgtgaaactactcttcttagatgctaatgacgtcacgttaatttcacgttataaggaaacaagacgttctcaccccttatctccacaaggtcggatacttgatggagtagaattagaacggaagctttcaaccgatcttaagagccaagcagatatagtaattgataccactaatgtgacaccacgaaatctaaagttaaggcttaataaattattcggacatggtgaaggtaatgacttttatgttgaagtaatgtcgtttgggtttaaatatgggttgccacttgatgcggatatcgtaatggatgttcgtttccttcctaatccattctatattccagaattaaagcacttaacgggaaatgatccagctgttcaaaattatgttatgcagagtccgctggctaaggaattttaccagcatttacggtcgctcttagagattgctcttccaggttacattaaggagggaaagagcagtttgacaattgcaattgggtgtacgggtggtcaacatcggtcagtaactattgctaataaattatccgctgatttaaaagaaaaaggatataaagtaaatacttaccatcgcgatattgagaaggcaaagtaaagaggagttttaattatgttgcataaaccaaagattgtagtaattggtggggggactggtttaccagttgtccttcgcggattgcgagatcaaaacgttgatgttacggcagtcgtaacagtagctgatgatggtggttcttcaggaattttacgaaattatattaatgtggttccacctggtgatattagaaatgttttagttgcgttatcagaattgcctgatctcgaacttgatattttccaataccgatttaggagcagtgatcagttctttgctggtcatgcgattggtaatttaattatctctgctttgtctgaaatgaagggtggtatttttaccgctgttcaagagttgtcagaaatgatgaagattaatggacatatttatcctgttgccaatgagccgttgaccttaaatgctgaatttacagatgggacaaagttaagtggtgaatcggaaataacggctgcccataagcaaattaaacgagtctgggtaacaccttctaaagataatgacggtcatcccgctcgtcctgtatcagaggtcataacagcaataaagaatgcagatcaaatcgttcttggtcctggaagtttatttactagcatcctgccaaacttgatgatttctgaagtagggcaggccgtttgcgaaagtaaggctgaagttgtctatatttgcaatattatgacgcaaaagggtgaaacggataattttaccgatgctgatcatgtgcgggtattaaatcatcaccttgggaagaattttatcaatacggtcttagtcaatattcaacctgttccagaaaattatcttgattttcaggaatggaatgaaatttctcaaccagttaagcatgatttccaagggctacgagcacagcattgtcgcgtaattagttcgaattttctgcggctaaaagacaatggtgccttccatgatcgcgataaagttgtagcagaattaatgaatcgaattcaccaggttcacgagtagttaggagactgatgctagatgtcatatgcaagcgaagtaaagaaagaattaacgggaatcactgttcatcgggataatgcaaaggcggaattgatggcccttattcggatgaacgggtcgattggcattgctgaccaccagttggtactgaatgttcagaccgaaaacccagcaattgcacggcgaatctattcactgttaaaacaattttacggggtagaaagtgaaatcgtggttcgtcgtaaaatgaaattaaaaaagaataaccaatatatagttcgcttacgctatcacgcacaacatgtcttagatgatcttggtatcttacaaaattatcaaatcaaagaacaagtacccgtagaattgctcaaggatgaatggatggtccgttcatatctaagaggtgcctttttagcggggggatcagtaaataatcctgaaacttctcgctaccacttagagatatactccctttatgaggaacataatgagatcattgctcagatgatgaataaatttggcctaaatgcccagacaaccgcacgccgtagtggctttatcgtttacttaaaagaagccgaaaaaatcgctaattttatgtcgttaattggagcaactaactcaatgcttcaatttgagaacgttcgaattgtgcgagacatgcgtaattcagttaatcgattagtaaattgtgaaaatgctaacctgaataagattgcgaatgcgtcaacgcgccaaatcgaaaatattgaattcattgattcgcgagtagggcttagcagcttacctgataagttgcgggaaattgcagaaacgcgattagcccatcaagaggttagtttaaaggaattaggagaattagttcctggtggtccaatttccaagtcgggtgttaatcatcgcttacgtaaattaaatgcttatgctgatgagttgcgtgcatcagaggttaaacaataaaaaacctttgaggatgagaaaaaataagcttttttctcatcctcaaaggttttattttatcttctttaagtgaaatttatttcttatttatactttcactaattagcgctaattcagctgctgcacattcttgatctaattcgttccagttagcggtaacgttaaaaacgtttaatttatttactgacattgtaacatcctccttgaccttacacctttgttctctttcgtctacatcttgtatcatactataattggtctaaaagtcaatcattataatgtcaatatttatataagtttttttagaattggtatagttcaattgctagaagtactaatgtaataacaaagataatcgtttatcaaagttagataagataaattgttaaattattggaaatgacattcacgggatagttgttttggattaagggagacttgctttttaaaacaatgaccggtataattggaacgttaattaatttacgtttaatattaaaggaggcaaagtaacatgcgtaaagcacacccatacggcgtacaaggccgtcgcccaatcgcttcaaagtacaagcgagcattaaaagaaaagaagatcgaagctattcgtaagtgggctaaggaaaagccagctgaagaaaagtaattcagtctataaaagctatgcaatccagtgcatagcttttattttttaataaaaagaaaaaactaaagcattaattaagaagaattttagccttgtttttttaatttaatttatgatagtcaaaaatattttgcaaaaaaatgttaaataatagttaaaacatttgaccttttttgaccaatcgagtatagtattattatccgttagcatataagactaacgagtgctaatttattaaggaggccatatcatgaatttagtacctactgtcattgagcaatcatctcgtggtgaacgtgcttatgacatctactcacggcttctgaaggaccgtattattatgctctctggtccaattgaagacgaaatggcaaattcaattgttgcgcaacttttattccttgatgcgcaagattcaactaaagatatttacttatacatcaattcacctggtggggttgttacctcaggaatggcaatttatgacactatgaactttattaaggctgatgttcaaactattgtaatcggaatggctgcttctatggccagtgtattagtatcatctggtgctaagggtaagcgttttggattaccacactcacaagttttgattcaccaaccatctggtggagctcaaggtcaacagactgaaatcgaaattgctgctactgaaattttgaaaacacggaagatgcttaacggcattcttgctaagaattctggtcaacctatcgaaaagatccaggctgatactgaacgtgatcattacttgacagcacaagaagcagtagattacggcttacttgatggtgtaatggaaaataattcaaaattaaagtaaagtgataaataaaaagatctccaattattcgatcgttttcgaatgatggagatcttttttgaattatcaaaaaggtgagaggaaattaacatctttgtggcaatgagatatcttagaaatgaaaaaaagaggctgggaattaactattaatttttggttctcaaacagtaaaatccggactatgatttttgatcggttcaaaaatcgtagtccggattttaaattatttatgaaattagtctccaatcgactaattgattggccaaatttcgttagatttaatgccatcagggctagcccaatgtcattttccacagcccgttggccacggagatgagttcggcgtatgccaaaatccctcttcatgtgaccaaagactggctcaacgtcgaacttccgtcgacgataaattgccttgccttcgtcacttgagagggcatctttaactttagctttataataattccaggttggattaaccttcatatagcgttgacgaccacctggtgtcttcgctagttcatctaatttaactgatagttgatgtttatcagcacgatagattttaaagtcacgcttaaagccatacttatcagtggatttactatagcgataaaaactaaaacgaactccttgatgatcaatgtagtagtcgtcattagcgttatattcccaattctgtgacctagttggatcgtttttaaatttacgtttctgttccttctgataggttgtgtatgggataaccggctgcttttcaaaccgatcaagaatcattgtgtaattgtactcacttccatagcctgcatcggcgacgatatgttcaaagaaatctaaagcatgaaactgggtaaggaatggcactaaggtcctggtgtcagttggatttgaaaacagcacgtaatcaagcacaaattgcttatgggtagcgatttgcaggttatagccaggcttcaactcccgattcatcatcggatcttccttcatacacatgaaggtcgcatcgtggtcagttttggaatagctattacgaccttggaagatattttcagcacgttcatacttttgggcacgcggaattaggtcgttgcttaattggtgacgaagcttttttagaaaacgacggcgccgttttctaactgaaccacctttgatgatttttggttcttgcttaatctcttcatctaatttagtgattttctccgccagttcttgttccattacttccatgccttcggcggaagtaaccagctccggtgtcatttcttgcaccacttgcttttctactagttcctcataaagcttacttgtcttttctcttaacttagcgtgatacttttcaactgcccgtcgccaagtaaatgaatatttattggcatcggcttctaccttggtcccatcgataaaaactgcatcattttgaattagtccgtgatctttcaaagccatggtaaagtaaacaaaggcatgtttaattagcttactagcgtgctgactgcggcgaaagttattgatggtatggtagctataagtataatcatgggctaaccaacgcattggcaggttctcatccaacataatttcaatctttcttccagaataagtttgacgtgagtaggcaaacaagagaatcttaagcataattgctggatgcgatgaagggcggccggtagccgctcctgaatcttataatagcacatcttgtggaatcgagtcgacaaaatcactaattagtcgcgcaacatgattctgtggtaaatcatagttatagtttagtacgaattcggtttgccctatggtataattttgatacatggaaatcgctccctttggttgtttttaggggtaattacatcatatcaggaacgatttcctgtgtacataaaaaccggataatgaattgtttgaacaattcattatccggtttttattttggactaggagttttttcccagcctccacataaaaaatgcgccccccgagagtcgaactcggatctcgagaaccggaatctcacgtgcgatccattacactaagggcgcgtcaacaaatattatattatcttaaacaaaaaggaattgcaagcattatttgaaaattttaatcaaaataacgcttacatcagaaaaatgttgtgattgaatagacaatttttttgaagatggtatcataagtatcgtaggagttgtattattgcttagaccttaccactgcgtcacttacaatggttgagagttgcgatgctgatgtaatgtgataaactaagcaagtacactaattatgttttttcctaaaggaggaatttgcagtatgactgtaaaaattggtattaacggttttggccgtattggtcgtttagcatttcgtcggattcacgaacttaacacaaatgatattgaagttgttgcaatcaacgatttgactactccttctatgttggcttacttacttaagtatgactcaactcatggtaagttcccaggtgaagttacatctactgatactggtattgttgttgatggtaaggaataccctgtatacgctgaacgcgatgctcgtaacattccttgggtaaagaacgatggtgttgactttgttcttgaatgtactggtttctacacttctgctgaaaagtcacaagcacacattgacgctggtgcaaagcgtgtattgatttcagcacctgctggtaacatcccaactgttgttcctggtgttaaccttgatactttgactaaggatgacattatcgtatcagctggttcatgtactactagctgcttggcaccaatggctaaggtcttaaatgacgaatttggtgttaaggttggtactatgactactatccacgcatttacttctactcaagctatccttgatggccctcgtggtaagaagatgcgtaacaaccgtactgcaagtgtaaacactattcctcactcaagtggtgctgctaaggctattggtttagttattcctgaattaaacggtaagctttcaggtcacgcacaacgtgttggtgttgttgatggttcattaactgaacttgtttcaatcttagacaagaaggttactgttgaccaaatcaacgatgctatgaagaaggctactaacccagcattcggttacactgaagatgaaattgtttcaactgatattatcggttcaacatacggttcagtattcgatccttcccaaactgaaattatggaaggtgacgatggttcacaattagttaagactgttgcttggtacgacaacgaatacggtttcactagcaacatgatccggactttacttcactttgctactctttaatttgaagtaaaattaaactaatttgattaaggtgggaggaggactactctgcccgccttttttcatcaagagaagaggagacataatacaatggctaaattaactgttgaagaccttcctttagaaggcaagaaagtattaatgcgtgttgactttaatgttccaattaaagacggcgttgttggtgacgacaatcgaattgttgcggctttaccaacaattaaatatgttattgaccatggtggtcgggcaatcttattctcacaccttggccgaattaaaaaagaagaagacaagcctggactttcacttcgtccagttgcggaacgtctttctaacttactaaacaagccagtaacatttgttccagttactgaaggtaagcaattagaagatgctatcgataacatgaagaatggtgatgttttacttgttcaaaacacccgttacgaagatgttaaggatggcgaatatgtaaagcgtgaatctggtaatgatcctgaattaggtaagtactgggcttctcttggtgatgtatttgtaaatgatgcttttggtacagctcaccgtaagcatgcttctaatgtcggtattgctactaacatgccgggcaaagcagcagctggttacttgatggaaaaggaaatcaagttcttaggtgacgcagtagataatccggaacgtccatttgttgccatccttggtggtgcaaaggtttctgataagattggtgttattgataaccttcttgacaaagcagacaagattattatcggtggtggaatggcttatacattctacgctgctaagggaatcaaagttggtaactcacttgttgaaaaagacaagattgacgttgctaagcaaatcttagataaagctggcgacaagcttgtattgccaattgataatgtagtagctgataagttcaacaatgatgctgatacaaaggttgttgaaggtgatattgacaacggttggatggctcttgatattggtcctaagtctgttgaagagttcaagaacgtattaaaagatgccaagactgttgtttggaatggaccaatgggtgtatttgaaatgccaaactttgctaagggtacgcttgaaattggtaaattccttggtacattaacagatgctacaacaattgttggtggtggagactcaactgctgctgttaaggaattgggtgttgctgataagcttactcacatttcaactggtggtggtgcatcattaacttaccttgaaggtaacgaattgcctggaattgcagcaatttctgacaaataattaatgtttaactactatttataattatataagaggctgagaaaacttttgcttttctcagcctcttaccgtatcttggtattaacaataaaataatagataggagggtcaaataatgagagtaccgattattgctggtaattggaaaatgcataaggatgtacaagaagctgtctcttttatcgaaaaagtaaaaaatcagcttccgcctgccgaccaacttgaaacagcaattgctgctcctactctttgtttagtaccaatggttaaagcagctgaagaatccccgttaaaaataatggcagaaaactgctactataagaatgagggagcttatactggtgaaacaagtccatatgctttataccaagcaggaatccatcatgtgattttaggccattctgaacgccgaacttactttaatgaaactgatgaattaattaataaaaaagtgaaggcagcattagtaaatgggttatgtccgattgtttgttgtgatgatactatgcgtcgacgagttgctggaaagaaagttcattgggtggtgagccgaattctcgctgaccttcatggattgaccaatgacgaaatttgtcatgttacggttgcttatgaaccaagttgggcgattggaacaggcgagagtgctgatccagaacaagcggcggaaggttgttaccttattcggcaaacgattagtgatatgtatggcgatgaagttgcaaataacgttcgaattctctatggcggaagtgtgacaacttctaatatcaatgcactaatggcaaaaaatgatattgatggtgttttagtcggagcggcgagcttaaatccagaaacatttttacaattagttcaccattaggcggttaaatgcttgtttttaattgtgtaaaataatacaatgttaagtggaattgctttccaaataaatgacagaggagagattcatcaaatgtcactcattacagatatttatgcacgtgaagtccttgattcacgtggtaacccaacagttgaagcagaagtatacacagaagccggtggtgtaggccgcggtatcgttccttcaggtgcttcaactggtgaacacgaagctgttgaattacgtgacggcgacaagaaccgttttggcggcaagggtgttttaaaggctgtttcaaacgtaaacaacattattgctaaggaaatcgtagggatggaagttactgaccaaatcgctatcgataaggcaatgattaagttagacggtactccaaacaagggtaagttaggtgctaacgctattttagctgtttcattagctgctgctcgggctgctgctgacgaattacaagtacctctttacaactaccttggtggtttcaacgctcatgtattgccaacaccaatgatgaacgttattaacggtggtgctcactcagataacaaggttgacttccaagaattcatgattatgccagttggtgcaccaactgtacgtgaagctattcgttggggttcagaaactttccacgccttgaagaaggaattggaagctgctggtaaagtaacctctgttggtgacgaaggtggatttgctcctgactttgctaacaacgaagaaccattcgaatacttaatcaaggctattgaagatgctggttacaagccaggtaaggacattgctattgcctttgacgttgctgcttcagaattatggaacgacgaagacaagaagtacaagcttcgttggtcaactggtgaagaatacaccactgaagaatggattaactacttatccggtattattgaaaagtacccagtagtatccgttgaagacccaattgacgaaaacaactgggatgactgggtaactattactgataagttaggcaagaaggttcaacttgttggtgatgacttctttgtaactaacactgattacttgaagaagggtatccaaatgggtgctgctaactcaatcttaatcaagcttaaccaaattggtactttaactgaaactgttgaagctatcgaaatggctaaggaagctggttacactgccatcgtttcacaccgttctggtgaaactgaagacactactatcgctgacttggttgttgctacaaacgctggacaaatcaagactggttctatgagccggactgaccgtcttgctaagtacaaccaattaatgcggattgaagatcaacttggtgatgttgctcaatacaagggtattcactcattctacaacttgagtcaacaagctcgtcaagacatcgaaaatcgttaattttaagcattagttaaaaatcaaaagaggctgggaaaaaactcctagtccaaaataaaaaccggatgatgaattttttgaacaattcatcatccggtttttatgtacacaggaaatcgttcctgatatgatgtaattacccctaaaaacaaccaaagggagcgatttccatgtatcaaaattataccatagggcaaaccgaattcgtactaaactataactatgatttaccacagaatcatgttgcgcgactaattagtgattttgtcgactcgattccacaagatgtgctattagaagattcaggagcggctaccggccgccctttatcgcatccagcaattatgcttaagattctcttgtttgcctactcacgtcaaacttattctggaagaaagattgaaatgatgttggatgagaacctgccaatgcgttggttagcccatgattatacttatagctaccataccatcaataactttcgccgcagtcagcacgctagtaagctaattaaacatgcctttgtctactttaccatgactttgaaagatcacggactaattcaaaatgatgcagtttttatcgatgggaccaaggtagaagccgatgccaataaatattcatttacttggcggcgggcagttgaaaagtatcacgctaagttaagagaaaagacaagtaagctttatgaggaactagtagaaaagcaagtggtacaggaaatggcaccggagctggttacttccgccgaaggcatggaagtaatggaacaagaactggcggagaaaatcactaaattagatgaaaagattaagcaagaaccaaaaatcatcaaagggggttcagttagaaaacggcgccgtcgttttctaaaaaagcttcgtcaccaattaagcaacgacctaattccgcgtgcccaaaagtatgaacgtgctgaaaatatcttccaaggtcgtaatagctattccaaaactgaccacgatgcgacctttatgtgtatgaaggaagatccgatgatgaatcgggagttgaagcctggctataacctgcaaatcgctacccataagcaatttgtgcttgattacgggctgttttcaaatccaactgacaccaggaccttagtgccattccttacccagtttcatgctttagatttctttgaacatatcgtcgccgatgcaggctatggaagtgagtacaattacacaatgattcttgatcggtttgaaaagcagccggttatcccatacacaacctatcaaaaggaacagaaacgtaaatttaaaaacgatccaactaggtcacagaattgggaatataacgctaatgacgactactacattgatcatcaaggagttcgttttagtttttatcgctatagtaaatccactgataagtatggctttaagcgtgactttaaaatctatcgtgctgataaacatcaactatcagttaaattagatgaactagcgaagacaccaggtggtcgtcaacgttatatgaaggttaacccaacctggaattattataaagctaaagttaaagatgccctctcaagtgacgaaggcaaggcaatttatcgtcgacggaagttcgacgttgagccagtctttggtcacatgaagagggattttggcatacgccgaactcatctccgtggccaacgggctgtggaaaatgacattgggctagccctgatggcattaaatctaacgaaatttggccaatcaattagtcgattggagactaatttcataaataatttaaaatccggactatgatttttgaaccgatcaaaaatcatagtccggattttactgtttgagaaccaaaaattaatagttaattcccggcctctttttagttacaaattatttaattaagattaaaaacgattacatcatttatattaaaaaataatgagaaagaagcgttggaatttagtatgaaatataatataatctttaagagttaaatacaatgaaaggatactgatacaaatgaaaaaatcggcaccagaacttaatcgttcgatgactgctggtcagatggaaatgatttcccttggtggagcgattggtgttggactgtttatgggatcaacatctacaatcaagtggacagggccatctgttatcctcgcatatgcgtttgttggcttaattttatatattgttatgagagcattaggagagatgatctacattaatcctggaacaggttcttttgcagattatgcaactgagtatgttcatccagtagctggatatcttgctaaatgggctaacgtgtttgaatacattgttgtcggaatgtccgaagtagtggctgcaactgaatatcttaaatattggtggcctcaccttcatacttgggtagccggagttgttattattattttcctggtcctcgctaatttagcaagtgcaaaggcatatggatcccttgaattttggtttgcgatgatcaaagttgttactattatctttatgatcttacttggatttatgattatcttctttggatttggtaatggcggccatccaactggtttcagcaatctttggtctcatggtggattcttcactggtggctggagtggtttcttcttctcaatgtcaattatcgttggatcttatgagggaattgaattgctaggaatttctgccggtgaagtagcaaatccgcaaaaagcaattgttaaatctgttaagtctgttttattccggattttgattttctacgttggtgcaatttttgtaattgtaacaatttatccttggaatgaattaagcagtgttggatcaccatttgtatctacttttgctaaggtcggaattacagctgcagcctcaattattaactttgtggttttaaccgctgcattatcaggtgctaattcaggtatttatagttcaagtcgaatgctgtttaagttatctcatgaaggggatgctcctaagatttttggtcgtctttcaaaacggatcgttcccgatgctgctatccttggtatttccggtggtattttgattggctttattattgatatgatttcggcaacttataaccactcaactgctgatatgttcgtggttgtcttcagttcttctgttttacctggaatgattccatggtttgtaattttactagcagaattacggttccgtcgtaataataaagacttaatggttgatcacccatttaaattaccactatatccattttcgaattactttgcatttctcatgttgattgtgattgtcatctttatgtttattaatcctgacacacgggtttcagttattgttggtgctgcagtattgattctagcagtcgctgtataccttattcgtcatggctttacaaacgagaaagcataagataaataagaagctaggaaaaatccctggcttctattttattttaaaattaatttcgtctcactaagctcatgtagtacaatggcatgtagacttttaataaattggagaaaaacaatggagagtagaaaagaggcatttcatcgctataatcagttcaatcaactaattcgggcgatcattattggaatattaactggtttagtagttagtgtatttagactcataattcaacactttttacaattagtaacagcaagttttgcatattttcattctcatccattatggctaataccatggacgattggatcaattattttagcattattattaggatggttagcccaatcctatcctgatataaaaggttcagggattccacaggttgaaggacaattgactaatcagtttgatgaaaaatggtggccagtgttatggcggaaatttcttggtggaattttcgccattggatccggattatatctcggacgtgaaggaccatcaattcaacttggggcaacaattgggcaaggagtagaggaaaaggccaaagtagggcaccttaatcgtcaaatagggattgcaagtggagccgcagcaggattatctgcagcctttaatgcaccaatcgctgcgactatctttattttggaagaagtgtatcataatttttcaccggtaatttggttggcaacatttgtgagttcgctttgttctaatatggtttcgatgcagttttttggcttacgaccggttttgaatgttccctataatcatatgcttcctaataatctttattggcacttgattgcgcttggtattttattaggtatcttagggcgtctttaccaaattgttattttgcatttgaatggttggacagcacggattcctaaactttccccgatcgcctacccaattattccgtttttgctggttattcccattgcctggtattttccaatcacactgggcggaggaaatgaattaattattattttgcgctccttaccattttctttagcactttttgtggggctttttgtccttcgctttgtattttcaatgattagttatggttcgcaattaccaggtgggatattcttgccaattttaactcttggtgctattttaggcgcagtttattgtgcgttaatggttcgcttgggattaatgccagttcgatatttgccgaattttattatctatggaatggcaggttactttgcatgtattagcaaggcgccatttactgctattttattaattactgaaatggttggctcacttgcgcatttaatgccattagccttggtagctgtggtagcttatcttgttgtagatgcgttacatggtgaaccagtatatacagcgatgtttaatgcttttattggcaacaatccacaaccagcacgccataaagaggatgttacaatgtcgattaccatttatgctggagcacggttggatggttgtaaaataaaagattttccgtggccaactgattgtattgtgatggttatttatcgaggagaagaaaaaattattccgaatggccaaacaaagctgcaagcgggcgatacattaattttacgtgctaattcagcgactactagacaagcttaccatgagataagtcgagccgcgcattatgcacaaggatagcaatagaacaataaatatgatatgataattaggataaaagcgtgaaagtattaggaggaaaaatccttgtataacacattaatgactttattcttaattgattgcgttgtattaattgcgtgtgtaatgatgcaaccagcaaaaaaacgataatgatgcaatgtcagctttgacaggtggtgcgggtgacttattctcacgtcgtaaagcgcggggatttgaagctgttatgcagattgttacaacaatttgtggagcactcttctttattctggcattagcgatgatttacgtttcgtcacattaaatttaaagtgcctcctgaaattattgtgattccaggaggcttttttgacgctacggttggagtgtaggggatgatgtagtgataacgtatactggtgagtcttttttctttccccatagtggacgtcgtggagttattttgcttcatgcatatacaggaaatacgaatgatgttcgaatgttaggacgtcagcttaattggcaagggtatacagttttcgcaccgcttttgagtgggcatggcggtgatccgcgaaaagtactagaaagcaatggtccaggtgattggtgggatgatacccggatggcaatctttcgtttacgcgatgctggaattgatcaaattgcgatttttggtttatcgctcggtggtttacttgccaccagggctcttgagaatgatccgcaattattaggtggtggtgtttttgcatccccaattaccacctggggacaatcaaatgttccggaatactttcctaaaattgcggcagagtattatcgtcgacaaaaaattacccccttaattactaaggaaaaggttgctaaattgactgaacgactccccaaacaactagcacaaattcaaacaatggcgcatcaaatttgtgaccaattagatcagattcatcaacctttctttattgcacagggaggcgcggatgaaatgattgatccagtgtctggcctgcaattaaaagcaagattacaagcaaatggggttgtagttgattatcattactacccaaccgctactcacttattaacagttaataccgctcatcgtcaattatttgccgatgtagaaaaatatttacaaaatttattcgaggtgtcttctaatgacaacaaataatttaaaagaaaaaatattaacacatttaacagataatgcaggtgtgagttactcagcagaaaaacttgctcatcaattaggaatggatgatgctgagcagtttacaccgatcgttcaatctcttgctcaattggaaagagagaaaaaggttcaagtaactgatcgtggtgaattcgaagcagttattaaacagcaaccacttattggaactttccatggtaatgataagggatttggttttgtagactatgacccggatcttccagacatgtatattaatcctgatcacactttgtatgcattaaatggggaccaggtagaagttaaagtattacgtccagcaaaagcaggtagtgatcagggtccagaaggtcaagtaacccggattgttgaacataaatatgaaaatgtagttggtgaatttaagcaagcgactatcggcgatgattacattggtgaaattttgcttaaagataagaaattatcgcagtatcatttctatgtaacggacaagggattaaaaccacttgacggccaagtagtaacagctactgttgagacttatcctagtgatgaggcaccggaagtaatgacgggtgccgttactgaagtgattggtgataaggatgagccgggtattgatattatgtcagtaatctatgctcacgatgtccctcatgaattccctaaagaagtgatggaacaagctaataagattccgcttcatgttctcccagaagaaaaaaagggtcgggtggatattactgaccaaccacttgttaccattgatgcaattgaatcaaaagacttggatgatgcggtggtagcttggaagatggataatgggcactaccaccttggggttcatattgctgatgttactcactatgtaaagccaggtacaccgcttgatcaagaagcatttaagcgtggtacatctgtttatctaactgatcgggtagttccaatgcttcctaagcggctttctaatggaatttgctctttaaatcctaatgaagaacgtcttgctatgagttgtgaaatggaaattgatgagcaaggaaagatcgttaatcaccgaatcttccaaagtgttatgaaatcacatgcccgaatgacttataaagcagttaataagattctggagtcgcatgatgctaaaacgatgaaacaatatgaagacctcgttccaatgtttgaaacaatgggcgagattcacaaattattgcttaaaaatcggaaaaaacgtggtgctattgactttgaagctcctgaagcaaagattattgtggatgaaaaggggcacccaactgatattcaactacggaatcgaggactttctgaacggatgattgaatcctttatgttagctgctaatgaaacagttgctgaacactacttcaaagaacgtgttccattcctttatcggatccacgagacaccagatagtgaccggattaagtcatttgtggactttttggctgtgtttgggattgatgttcatggtgatattaaaaatgttaaaccagggatgcttcaaaaagtattaaaggatgtggctggtactcctgaagagcaaatggtccaagtgatgatgttacgtagtatgcaacaagctaaatactcggatgaagagctaggtcactttggtttaggcgctaaatactacacacactttacttcaccaattcggcgataccctgatgatacagttcaccgcttgattaagtggtacgaagaacatggtaaaaacgaaccagctaaggatcattggcgtgacaagcttcctgaaattgctgaacatacttccgttaccgaacgacggggaattgatacagaacgtgatgttgacagtatgaagaaagccgaatacatggaagatcatgttggtgaaacctttgatgccgtcgtaagttcagtaatgaagtttggtttgttcgttgaattaccaaatacagttgaagggttagttcatattagcgtcatgaaggatgattattatgaatattcagaaaaacacatggctctaatcggacgaaactctcatcgaattttccaaatggggcaaccaattaaggttaagttagttcgagcagataaagatcttcgtgaagttgactttgaaattgttaaccctgaagaggcaccaaagacaaagattcgggttccacgtaatgatgagtatcgtggtcgaggtcgtggtcgcaagggacgtaccaataataattcccgtcatgagaataataatggtaactattaccgtaatactcaaggaaaatggcgtcgcactcatcaagaaaacggacatcaaaataatcgtcaaataaatcggggacaaactcgtcaccacaataattcacgtgatcatgaaggcgttcgtcgccaccattaagagcggggagggatattatggcaaaaaaatcccatcaagaaaataatgacaatttaattgcgcaaaataaaaaagcacgtcatgattattttgtcacggataccgttgaagcaggattagttttaacggggacggagataaaatctgttcgtgctcaccgggttaatttgaaagatggatttgcccaagttcgtaacggtgaagcttggttaatgaatgtgcatattagtgagtatgataatgggacttacttcaatcaagatccattaagaaatcgtaagttgctattgcacaaaaaggaaatcaataagcttgtaggagccttacaggataagggagttacgcttattcccttaaaaatgtatattaaacacggctatgcaaaggttttattaggactagccaaaggtaaacaccagtacgataaacgtgaagcaattaagcgtcgtgaacaaaaccgtgaaattgaacgagttatgaaacattattaaaacgaaaggcctaggtgaaaatcacaaattttcacctaggcctttcactttaaaatctatttgtttctgcgttctttacagtttaagtttaactgattgctaattgaaaatgacatgctggtattaagattaggggaacgcttcattaatcgtgctaataaaggttcttgttcacttcgtcgagcccaatggttaagaatactagcgattagaattgctagaggttcatcttcttttttatttatctttaattcatgacaatatccgcttgatagtttaacgggttgaattgaaaaaactaagtgactaccggaaaaaacacggtaacggcttgttaatggtgaaccaacaacgatccagttaataccgcgtatataaataacctgttgaacaaatccaagacctttcccaattgttccaacgcgttgtcgattaacatataatgcgaatttgggtaacagtccaagagttaattgctttacttcagctaataaggctccatcaattgcatacaatgatagggcatcgtacctcattccccacttaccgacaagaagatagcacgatttaccattcttatcgcgaatgacggtcgttccatgtaaatcacttgaacgatcgcgaatatataattgtcgcactttgccaccaccattctttgataatctaccttttattttaccagcttcttagcaaatttggtgaagaaacttctaagttaaaaaacgcttccaatttatcccatgatgatgtttaattatgctaaaataataggcgaggtgctaataatcgtgaaacaattaattcataacgactggtgggaagttttaaagccccagtttgaaagtgcgtattatgcgcaattgcataatttcctaaaagaagaatatacccatcaaacgatctatccagaaatgcatcatatttttgaagcatttgaatggactccttttagtaaggttaaagttgttatccttggtcaagatccttatcatggaccaaaccaagctcatgggtgtagtttttcagtactgcctggggtaccggtcccgccttcattacagaatatttacaaagaattgcaaagtgatttaggttgtacaccggtaaatcacggctatttgaagaaatgggctgatcaaggtgtcctgttgttaaattcggttttgacagtacgagcagggcaagcatattctcaccgtggacatggctgggagcaattaacagatgcggcgattcatgctttatctgaacgtcctaaaccagtggtgttcatcttgtggggacgagctgctcgaaataagaaacagttaattaatacgaagacaaatatcgttcttgaatcagctcacccgagtccattatctgctaaccgtggattctttggttctcgaccattttctaaaacaaacgaagcacttcaggcaatgggagaacagccaattgattggcaactgcctgccgaaccaaattatcgttaaagatgtgattgttagtcacaactttaaaatgtttagtgaccataaggaggtacttgcattatggaattatttgatgagattgctgcaaagattaagggacaaaacaagacaattgttttccctgaaggtgaagataagcggattttaggagctgctgtccgcttaaagaaagataatttagtagagccgattttacttggtgatgaagaagcgattaaagaagttgcaagtaaaaacggttttgatcttgctggccttcaaattatcgatccagcaacttatccagaagacgataagcaagcaatgtttgactcattaatggaacggcgcaaagggaagaatactcctgaagaaattcaaaagatgcttgaagatgtgagctactttggaacgatgcttgtttacatgggaaaggctgatggaatggtttctggtgctgttcattcaactggggcaactgttcgacctgcattacaaatcattaagactaagcctggtgcccatcgaattagtggggctttcctcatgattaaaggcgatcaacgttatatctttgctgattgtgcgattaatattgaattggatgcgccaacaatggctgaagtggcaattcaaagtgcagaaacagctcgcttatttgaaattgatcctaaggttgcgcttcttagtttttcaactaagggttctgctaagggcgaaatggttaccaaggttgcggatgctgctaagctagttcatgaattggatcccgacttaccagctgatggtgaactacaatttgatgctgctgttgttccatcagtaggtgaacttaaagcccctgattcaaaagttgctggtcatgccaatgtctttattttcccaagtctggaagcaggtaatattggttacaagattgcgcaacgatttggcgggtttacagcagttggtcctattcttcaaggacttaacgcaccgattgcagacctttcacggggatgtagtgaagatgatgcttataaggttgcaatgattaccgcagcacaagcattgtaaatattgatgaaaaggaagtgggactaaaaactcgcaagcgagtttagtcccacttcctttgctttttaaacatgagatgggtacaataaggctagtattttaaacttggagagagtactatggagagcttaacgttaacgaatcgggacgcaacaattgcccttggaaagaaaattggtcagcaattagttgccggggatgtgctagtcttagacggtgatttaggagcaggcaagactacttttaccaagggattggctgcagggttagaaattcctgatatcattaaaagtcctacttttacaattattcatgaatatcaagatggccgtctccccttatatcatatggatgcatatcgcttagaaaatgggggagcagaagatctcggacttgaagaatactttgatggtgatggagtttcagttgttgaatgggctgaatttgttgaagatgaattgccagctgactttttagctatccacttcaagcgaacagatgatgataatactcgtgttctggaatttgaaccccatggacagcattttgaccaaattgtaaaaagcgtggtgggataatggcagatgacatttcgataaagctagcaacgagtgaggatgccggggctgttttgcaatttttacgggtaactgcaactgaaagtgacgcggtattagttccgcatctaaatgagattagtgaaaagacagaagcaaaaaatatcgatttaataaatcaatttgatgattgtgttattttacttgcgatgctcggcgaagagattgtggggatggttactgtaatggtattagatcatcaaccgacaaccggtgaattaggagtcgtggtacggaaaaagtattggcgaaacggaatcggtcgcttattagtcgatgaagcagaatattggtttaatacttatagtagtttagaaaatttggtcctgacagtttttgaggataatattccggcaattaatctttatcagcaattacactttgttacaataggaaaaacagttgagcagggtcgtaatgtcctgcaaatgcaatacgataataaaaaagaggaaacaatggaaaagtaagccattatttcctctttctttgtatactagctttattttttatgtagtacttgcataatgtttcgccaaaaggatccctttgcttgctgtttactaacgtcttgcgttacctctacacatccaaggtatttattttgatcatcacgtaaggcgtaaaaggcaatatttacaggttgaccatgatgcttgatcataatgctaattgaatcgcggtctccgctatgcatatcatgaaggacttgtttaacatggttttgactatgcccgggatgaacctcaagcacatgtttacctagatctgcatcagttcgtttgaataaacgatgccgattggctgatgaccagcgaatgatgtcattttcatcaacgaaatcgaattctacggggatggtttcaaaaatagtattaagttgttcaatacttagttttccacctttaagattaatatctgtcatggttctctcctttagccgattaaattaataaagggctgaatttgttgcggggtaaaatgcttactttgataaagcagaatgttagcgcaagcctgggcatcatcaagagcattatggtggtgatgaaggtcaatatttaacgcgtcgcaaacagtattaagtttataatttgttagtcctggaatcaactggcggcttgaagcaacagtatcgagtgtctggtaggcggggacttcgatattgtaatgctctaacgtatttcttaaaacgctattatcaaaccgattattatgggcaataaccagtttatcaggagtgtagaattggttgatatgttcccatacttctggaaaatcaggcgcattttggacgtcacgctcatgaataccgtggatctgagtattacgccaaaagaatttagtatgaggattaattagggtgtaaaattcgtcggcaatttgtccattccgaacgattgtgagtgcaagtgaacatgcactgtaacgcttgccattagcagtctcaaagtccattgctataaaattcatcatacattctccttgcaaaagtcgataattttattttacaatcaactaatcatttttcaaaacttttacttttgaaaaatgatacaatagctcttgaaagtaaatacaaaaaaggaagaaatagagaatggctaatttgatgaacgaatttcctgatattgaaattaaacaagatgaaccattaatgaattacacctatactaaaacaggaggtccagctgactggttggcttttcccgaaacgattgaccaggtaaaagaattggttgattatgttcgtgagcatgaaatgggcttaacagttttaggaaacgccagtaatttaattgttggcgatggcggtatagatgatttaacaattattcttacgcggcttaataaaattgaagttcatgataataaggtaactgcacaggcaggggcatcttatattgcaacaaccgaggcagctcgtgatagtgaacttactggattagaatttgctgctggtattccgggcagtattggtggagctgtcttcatgaatgccggtgcatatggtggtgaaactaaaaatgttgtttctgaggcaaccgtaatgttgcccgatggaacgatcaaacaccttactaatgaagaattggactttggttatcggcatagcagtattcaagataataatggcgtcgtgttagatgctacgtttgctttggaaccgggtaagtatgatgagatcaaagcaaggatggacgatctgaatgaacggcgagaagctaagcagccattagatctcccatcttgcggaagtgtatttaaacggccagaaggatattatgccggaaagttgattcatgatgctggattacaaggttatacttcaggtggggcgcaagtttcgactaagcatgctggctttatcgttaatattgaccatggaaccgcagcagactacgtaaatgttatccatcatgtccaaaagacagttaaagaaaaatttggtgttgatcttgaaaccgaagtacggattatcggtcggcaagattaaaaatataaagtgtaagtttattaaaagattattaataagcttgcacttttattattttaaagatagtgaagcgatgaatgaatttaacctaatagttaggtaccgttaaaaagggaaaaaataatttaattcatcttattatttgttaattatgaaaaaatctcacaaattgctcattgaaaaattattattatggatgaaaagcgatttcaaaggattttgaagtataccgattcactgactgataaaaataactttgtaatcactttcaaaatatgataggatatttaagtctcatttttgaaaaaattcacaaagtaaggagtatatttatgagcaataatgtagttgttttaggaagtattaacgttgatactacttatcatgttgatcgcttccctcaacctggtgaaactatttcagcagtaagtaagagttctgctcctggtggtaagggtgccaatcaagcagttgcagcagcccgctctggtgccaaaacggcctttattggggcagttggttctgataaagaaggagcttacatgcttgaatcattggctgatgaccatattgatacacgccacatcatgactgatgagttacacggtactggtagtgctgcgattactttagatgctaatggtcaaaatgacattatggtatatggcggtgccaaccaagcaatggccactgatgttcttaatggcattgatgatgttttagaagatgctgactttttaattagtcaatttgaaacaccacaagaagttgctttaaatgcatttaagcaagctaaaaaatacggtgttactactcttttaaatccagcaccagctcatgagattttaccagagttattaaaatatacagatgttattacgcctaatgaaagtgaatgcgccttattaacaggtattgaaattactgatgaagaatcaatgttaaagagtgctgattacttccgtgaacggggagttaaacaccttttaattactttaggctcaaaaggagtattttactccacacctacagctcatggattagttccagcatttaaggttaaggcagttgatactacagcagctggtgatacattccttggggcattaagttcacaattagaaaaggacttatcaaatgttgacaaggcacttgtctacgcacaacgagcatctagtttgactgttcaacaaatgggagcaatgccttctattccaaaccatgatgcggttataaaagcattagcagaaaattaaggagtactatcatgaagaaaacagggattattaattcagaagtttcagctgtcgtggctaatatgggacatatggattggttatcaattggtgatgccggaatgcccgttccatttggtactaagaagattgatttggctgttgataaggaattgccaagctttatggacgtattgaataatgttcttaaggaaatgaaggttcaaaagatttacttagctgaagaaatcaaggaccaaaatccagcacaacttgaaaatattaagaaggcattaccagatgttgaggttgcatttatgcctcacagtgagcttaagaagagtcttaccaagacacatgccttcattcggacaggggaaatgacgccatactcaaacattatccttgaatcaggcgtaacattttaatattaggggttagtttttatggaaaatgaagtaaaaaaagagaatggacaaagttgggttcaactttcagacggttatttaagtcggacaccaatgttccaatttgttattttatgtttaatcttcccattatggggagcagcggccagtcttaatgatattttgattacacaatttaagacggttttcaccttaaatgatactgcaacagcctttgttcaaagtgccttttacggtggttatttcttaatggcaattccagcttcaattcttattaagaagacatcatataagttagcaattcttattgggctattattttatattattggttgtggaatgtttttcccagcttcacatgttgctacttatagtatgtttttagttgctatttttgctattgctattggtttgagttttcttgaaactagttgtgatacgtatgcaacgatgtttggaccaaaagaaactgctaacaaacggttaaacgttgctaatgttttgattcctcttggtgatatcatgggaatcgttcttggtaagtaccttattttcggtgaaggtggaaacattgccgacaaggttgctaagatgtcaaaatctgaggcagaagcttacaatgaacacttgcttcaattgactttgcagccttataagtatattttgattgttttaatcatcatctttatcgttttggcagttactaaaatgcctcgcgctaaggccttctcaactggttctgaaactaaagaagaccaaccatcacttggcgaaactttcaactacttattccacaataagcggtacatgaaaggggttctctgtcagtttatttatgctggtatgcaaacgactgtatggtcattcactattcggttagcattacgccttgattctcatatttctgatgcagctgcttcaactttcatgatctatagttacatcgcttggttctttggtaagttagttgcaaactggttccttgaccgttactcaattactaaggtattaacttggttctcattacttggaacaatttcattagtaattacctttactgttcctaacatcacagcggtaattgcggcaattgcaactagtttcttctttggaccagaatggccaacgatctatgctcatacccttgatcaaattcatgaaaagaagtacaccgaaactggtggtgcatttatcgttatgtccttaattggtggtgcaattgttccaacaattcaaggacgggtatcagatttaactggttcaatgcagttatcattcattgtcccagcaatttgtttcgcacttatcactatttacttctggactgagcaccgttgggaaaaggctcatccaaatgaagtgcaagaacactaaaatttcccaggaaataatttaatattaaaggcccagcggttatttaatcagctgagcctttatttatttccaaaactttaaagtaatttttttctagattaagctaaacacgaaatgaaatgatataatatgaacgtgatttagaggatggtgaatgcgatgcaatttataatttcgcttctaacatggcagaatctgattcacttaattgatatcttagtaatttggtttttaatctacgagttattaatgttaattcgtggtacaagagctgtccaactatttcgtggtattctgatcattattttggttaagattgttagttggtatgttggtttaagtactgtttcgtgggtaatggaccagattatcaactggggtgttattgcaattgtcattatcttccagccagagattcggcgcggactggaacaccttggtcgaggaactttctttactcataatcaaacagcaaatgagaaagaagaagatatgattaagcaattagaccaagcgattcagtacatgtcaaagcgaagaattggtgctttaatgagtattcaaatgaagactggtctagaagagtatattgaaacaggtattccactcgatgctgatatttcaggggcattacttattaatacttttattcctaatacgcccttgcatgatggagcagtgattataaaaaataatcggattgcagtagcggctgcttatcttcctttgtctgatagtaaattgattcctaaagaattagggacacgacatcgggctgctgtcggaattagtgaagtgacagatgcattgacaattgttatttcagaagaaaccggcgaagtttcaattacgaaagataatgaattaattcgaaacatgtcgcgagatgaatacctaaagttcttacgtgctcagttgtatacgcatgagcctcaacacgaaaacttggtaacagaactttatgctaagtttcaacgtaaaggaggtggccgtcatgggcaaggacactaaaggcttctttcgccggaaatggtttttgagaattatttcgttaatcctagcactctttctattcatgtatgtaaatgggagcaaaagcggcttccttcgtcaaaatactcggaataataaccagagtagtgctttaatgtcgaataaatccgttacccttcgaatgccccttgatgtgacaattgataataataagtatattgtcagcgggtatcctcaatatgttaaggttaaggtaaccggtccttccgcattggttacaactacctctaatactcaaaattttaaggtgtatgcggatttgtctgacttgactcctggtaaacaccgagtaaagttaaaaacgagtgggttaaattcagaattaacttctaaaattgagccacaatatattaatgttaatattcaaccacgcaagacgattacaatgaaagtaactattcgtttgagtactagagatttggataatggctataagcttggacgtccacatagtgatattcagactgtccaagttactggttcacgagatgaagttaataaagtaaatcgaattgttgcttttgtagcaattccgcacgatgcaaaggataatattgcacgacaggtaacactacaagcaattgatcggaatggtcaaacacttaatgttgtgacttcaccaactactactaatgtttctattcctatttctgcgggttcacaaagcagcagttcaaatgatagttcatcaagtagtagtggtagtgaagagagtgaagaagcaaagagtaattcaagagcaacatcgcgaaatgactcttcagattcttcatctgaaacatcccaatcttcaagtagtataagcaatgaagattcaagttcaagtagtcgaaatcaataataaagatacacatagaggagaagtgaaatgaagttaaaatattttggaactgatggagttcgtggagttgcaaatcaagatttaagtccagaattggcgttccgtgttggtcgcgcaggtggatatgtccttactcggcactcagaacgaaaacaacctcaagtattagttgctcgtgatacacgaatttcaggtgaaatgctagaaaatgcattgattgctggattattatccgttggtattgaagttttacggctaggggttgtcactactcccggggttgcttaccttgttcgggcacaagaagctgatgctggagttatgattactgctagtcataacccaattaaatataacgggattaaatattttggtggtaatggatttaaattatcagatgaattggaatatgaaattgaacaattactagatgctgaagaagatacgttgccacgaccatctgatgcaggcttaggaacagttgctgattatcatgagggagcattaaagtacacttcattcttggaacaaactgtttcaagtgatcttgaaggattaaaagtggtagttgatgctgctaatggtgcaacaagtggctttatctctaatctttttgctgatatgaatgtggactttattccaattaatgatcaaccagatggcttaaatactaacctaaattgtggatcaactcacccagagagcctccaaaaagcggttgtggaaaataatgctgatcttggagtagcatttgatggtgatggtgaccgttgcattgctgttgataatgagggaaatattgttgacggtgataagattatgtatatctgtggtaagtacatggataagaagggattacttaagaaagatacagtagttacaactgtgatgagtaatctgggaatgtacaaagctttagaagcacacaacttaaagagtgttaagactaaggttggtgaccggtatgttgttgaggaaatgctgaaaaatggttataaccttggtggtgaacaatcaggacatattattttcttagatcacaatacaactggggatggaatgcttaccgcactgcaactcttgtctgtagttaaagactctgggaagacactcgctgaattggcaaatgatgtaacaacttatccacaagagctattgaatattaaggtagcagataaaactactgcaatggagaatcaaaaattaaaggaaattattgcgcaagtcgagaaagaaatgaacggggatggacgggttcttgttcgtcctagtggaactgaacctcttttgcgcattatggctgaagcagctacgccagaattagttcatgaatacgttgaacggatcggtgatgttgcccgcgcggaattagaagtagaataacttgagaagtgaaaaagcgaggctggaagaaaatttattcttctagtctcgctttttaatcttttaataaattttaaatcatatagaccaatctaataaaataattgacaagataatctaaaaactgtactatacaatacagttgattagatttagtgataatcactagttatctataccaattttatttaaaggatggaatttaattatgtgtggaattgttggagttacaggaactgacaagagtttgtcaattctaattgatggattaaagcggcttgaatatcgtggatatgactctgcaggagtttacgttaatgatcaacaaggacatgattaccttgtaaagcggccaggtcggattgctaatctagaagcggcccttggagaagaagttcatggtttagccggtattggtcatacccggtgggctactcatggtgaaccaaacgaagccaatgctcaccctcaatactctcaagacgaacggttctacttagttcataacggtgtaattgaaaattatgctgatttaaagaaagaatacttatctgacattaactttgttagtcaaactgatacagaagtaattgttcaattagttgataaatttgtagttgaatctggaatgtcaacagaagcagccctccttaaggttcttcgtttaatcagcccagattcttcatatgcatttgtattgatggataaagaacaaccagatacattatttgttgctaaaaataagagtccattactagtcggtattgctgatggttacaacatggttggttctgatgcaatgtcaatgattaaagaaactaatacctttatggaaatcggtgaccacgagttggtaatcgttaagccagatcacgttactgttaaagactttgatggtaatgagattgatcggccaacatttaaggttgatatggatgctaatgccgcagataaaggtgcgtacccatactacatgttaaaggaaattgacgagcaaccagctgttatgcggaagttagttcaagaatactttggcgacaatgatatagcacaaattaatgaagagatgttaaaagatatggcaaatgccgaccatctttacatcgttggtgccggtacaagttatcatgccggtttagtaggtgcgcgtattttcgaaaaactttgtggaattcctacatctgttcatatttcatcagaatttgcttatgaacaaccacttctttctaagaagccattctttatcttcttaagtcaaagtggggaaactgctgatagtcgtgaagtgcttgttaatgttaataagcataattggccaagtttaacaattacgaatgttgataagtcaacgctttctcgtgaagcaacttacactgaattactttacgctggtccagaaattgccgtagcttcaacaaaggcttacactgcccaaattgctgtcgaagctattcttgctcaagcattgggtgtctacatggataagcaagcagctaaagactttgacgttaagcaccaattaggattagttgctaatggtatgcaatcaattactgatagcaagaagaaagtagaagaaattgcttctcgttatctctctaaatctccaagcgccttctacattggccggggaatggattggtcagtatcacttgaagctgctttgaagttaaaggaaatttcatacgttcaagcggaaggttttgcatctggtgaattaaagcatggaacaattgctttaattgaagatcaaactccagtgattgggatcattacccaagatcggactgctggtttaacacggagtaatcttgaagaaacacaagctcgtggggccaatgcaattacaattgtttcacggcatcttgcaaaagaagacgatacattcgttcttcccgatgtcgatgaagttttgacgccacttcttagcgtaattccagcacaattgttggcttactacactagtcttggtaagggacttgatgttgataagccacgtaacctcgcaaagtctgttacagttcaataaaattataaaggaagttagaaatgccttagttggtttttcaacttctttttatttttaaagtaatttgatgttttctttgaatttgtttaataaaagggttgacttacatttatggaaacgctatcataatagttgcaaggtataaagtaattaccttctaatcaattctctttctctcttatgccgatcatcgtcttttagacggtgatttttttatttaaactcgctataatgataagggttgaaaggggaataacaacgtggaagaacaacacgaaacgttaacattaattgaggaaattacccgtaatgacggctcaaaatattatgaaattggtaatatggttcaaaatgggcgtgcagaattagcagctgaacggggttttattaaagaggttcgtattttagaactaaatatccctcattctaaaaatgttattaaatatgaacactttataaatactcactataagatgcagactgaagcaatggatcattgggaagaatggaaacgtcccccagagattgaagaggttgttcaaacgatcttaaaagaaaatcatattgggtaaaacaggaagctgaattatttggtagtactaaaaatggatataaaaatgtggaggttaggcaatgaagccaaattttaatccatcacaggggatgaagtcgcactatttcgttacagggatagacggcttacgaacattagctgtcttaggagttattatttaccacctattgcccaatgttttaatgggtggttatttaggagtgccgctttttctattagtctctggatattttgtaacctatcaatttagtcggcagcttaagtatggtggtcatattaatttagggcatttttatctaaaaaggtttcggagactatatccgacattaattgcgatgctaattttaacggcagcgtatattacattatttgcgcgagaattactccataacattcgagcggtaattgttactaatttaacgtgggtatataattggtgggaaataagtcacgggcagtcctattttgatcaatttggtggcgtttcaccttttacccatctttggacattaggggttgaagcacaattttatcttctgtggcccttgattattacgttgttatttgtgatttttaagaaactacagaatgtgcggcgggtagtttttatattggctgtattgtcagcaatagaaatggctgttctttacgacccggcaaatatcaatcgggtttattatggaactgatacacgggccttttcacttttgcttggatcgtggttagggcttgcctggccattaaatcgacttcgacctaatttacaggcaaatagtcgccgtttacttaatactataggaattattgcaacagtattaaccattgttggctttttatcattgaatggacagtcatcttttacttaccgcgggggaatgtttctctatagctttattggaatgatattaatggctactattattcacccaggtgcggggatgaataaatggtttacaaatccggtttttcattgggttgggcagcgttcttatgggatttatgtttatcaatatcccgttatggtcttttatgaacgattgatcaatgtcggcaatcatccacttctcaatgcattcgtggaaattattattattttagtagtaagtgaagtttcttaccggttaattgaacgcccatttgcccagtatcagtggtcaaaattaccagctgatcttcagcatgtgttagaaacgcatcactttagttggcaaagcggggctaaaatgatggtaagtgcattagttgttgttattgcatttatcggtttttgtcagccaaaccgtgcaccaaagaaaacagcggttcagcaacggatagagcaaaatcatcaagctgctgaagaacacaataagaagattgcaaagggtgataatgttgcagaagctagtggtaatacttctaagcttcagaaacagtatgatttaactccggcgcaaataaaagcagcgcagaagttaaaggtaacggccatcggtgattcggtgatggctgatgccgcagatagtattcagaaattaatgccaaatgcttatgttgatgcacaagttgggcgtcaaggttctgcggctcctgatgttatcaaacaattaaaggcagatgggcatttaaacaagattgttatcttaaatttgggaacaaatggtccgatgactcaagatacgttggataatattttaagtgcaattggctctggacaccaaatctattgggtaactgcccatgttccaacaaagccatggcagcaaacagttaataatgaaattaaagatttagccaagaagcataagaatatccatgtggtcgattggaataaggcaagtcaagggcactctgattggtttgcaagtgacaatgtacatatgggaccaagcggaaatgatcattttgcacggttaattgcaaaaacgatcttgacaaaaaaataggaggttagtaatgacacacgaaggtcaattattagacaaagctatcaatatttacttaacgggactaaagggcatcgaaagctttatttctgaaccggcgagtgaatataatttatcttttgaacaatttttgattttacgaaaaatcattaaccatcctaatatcaaactaatggatatcgccgagcaacggcaagtaacaaggagtgccgtctctcgccaattaaaagtcctttttcagcaaaaatatgttgaacaaaaagctgatccagctgatcgacgtcggatgtttttagttgcaacaaaaaaaggcaaagatgctgaaagtgagatttggcaaaggattaatcaccgctttgccaattgggttcagatttatggtgaagatcgtgctgatcagtttttaacactttttgaagactttaatcaacaaataattcaggggaatatccgaaagaaggaataagaaaatgattaagatgattgcgctagacctagataatacgcttttaaatagtaataaagaaattagtcaacgtaatgaacatgtcctaaagcaattacatcaagagggaattaaggtagtgctttgtactggccgcccaatcaatgcaatttggccatatattgaacagcttggtttaactgattcagatgattacacaattacgtttaatggcggattagttattaataatgaatcacgtgaacatctttttgaattagggatgaaaaagagtgatttactgccactattttcttatgttaaacgaaaaaagattcccctcaatgttttagactttgaacgggtatacgaattaaatgattatccaggatctatttatcggacagtgttaaagaatattgaattccaatctttgccaatgagtgatatgccggaaaaaacttatagtaaagctgtaatggcaatcacccctgaaaaattgtctactattataggagaacttccagctaatcttaaagcgcagtatcatgcagttcaatcccaaccgatgataatggaatttttacctaaaaaattaaataaggcggttggattgaaggccttactggatcattttggtgatgattttagtaatttaatgacatttggggatgctgataatgatcttgaaatgatcaaagctgcggctcaaggaattgtaatggaaaatggtcttcctaacgttaaggcagtggcgacagcaatcacagatacaaatgataatgatggagttgcaaggtattgtgaacgttattttgcaacacttttgtaataaagattgttataaaaagtaaaataaagagtgtttttggcgcaaatatgaaacttttgctaaaaaaatactcttttttatttattatttaatgaattttcgataaaagttatggctccctaaaagctaactagcacaagggattgcaaattttataatcatattaattgacaacttatattacaaaatattacaaaaagccaacggagagtagtaaatagaaatggtgctgttacagcttagtaatattaagagtgtaatatataaggtgttgaaacgtaaaagataatttgctaaataataaaggatggttgtttaatttatgatttctaagaaaaactttgctaaagtatctgctactcttggtgcagtggccttaggtgttagtgcaacggctactgctgctaatgccgacactatctacaccgtgcaaagtggtgacacactttcaggtatttcttacaaattcgcaaaagacaacagtatggtcaatgatcttgctaagaagaacaatattcaagatattaacaagatttacgttggtcaaaagttaatcatcaagagcgatggtgaaattcaagaatacaacgctcaaaacgcagctaatgcaaatgtagctgacaataatactcaagctactcaacaacaaactgcacaacctcaacaagctcaaagtcaagctagccaaagttatacttcaaatgcttcaggttcagaagctgctgctaaggcttggattgccgctcgtgaatctggtggtaactacggtgctactaacggtcaatacattggtaagtaccaattatcagcatcataccttaacggtgactactcggcagctaaccaagaacgggttgctgaccaatacgttgcaagtcgttacggttcatggcaaaatgctcaggctcactggcaagctaatggctggtactaaaatttaaactaacaagcaaaagcgagactaagaagctgatcttcatagtctcgcttttttgtacaaatgtggtataataagtatacctcttatggggatgtttatggattcgacaggtataggtcgagtttcaattgcgtttcgaaggttgcgtcttcgtaaaaacgctcagttttaaattataactgcaaacaataattcaaactcttacgcatacgctgcctaacaagtagcgcgcgtagatccattccgggttcgtccatgatgcggcaatgggttttatacttagtggactacgcttattactcccgtttgaagtaataagaagagattaatcaagctagctaaccatggttgccctgatcaacggcgttttggttagtgaaatctaaatagttgagatatgaacgtagagattgaaatggcgatatgcttggacacgggttcgactcccgtcatctccactatatgcctataaggactgccattggtttatggcagtcttttttaatgctaaatattaggataattagtggggtttcataagaagatattctcatgtaaaaatcagtaaatagagttcagataaaatataaaggaatgaattaaatggaaatattaatgattgaggataatcattctgtctgtgaaatgatggcaatgttttttaagaaagaaaaatggcactgtgaatttgcttatgatggcgtggaagcagaagaaaagtttaacgctgaccctcataaatgggatattattttgctagacctcaatcttcctaaaaaggatggaatgcaggttgcagctgatattcgacgggtatcaccaacagttcccttaattatgttgacagcccgtgatactgaaagtgatcaggtattgggattggaaattggtgctgatgattatgtaaccaaaccatttagtacaattactttaattgcgcggatcaaggccctttatcggcgaacacatttaaacaaacttgaggatgttcaagatactgatagtgatgatacattcgatattcaaacaaagaactttaagatgaatactaagacaagagaagtattcttatatggaaaaccggtcggtgacttgacaccgaaagaatttgacttattaaagacgcttgcctctaaaccacgtcaagtattcacccgttcacaacttttacaattagtatgggattatgaatattatggtgatgagcgaactgttgatgctcatattaaaaagttacggcaaaagttagaaaatattggacctcaagtaattaagactgtatggggggtcggctataagtttgatgacgagggtaacgactaatgaaattaatgtatcggttgatgctttcattttttgcgattattttgacgctaatggtgattgttagtatttcgtttatcaatgtgactaacaacactatgtatcacaatacgtggcaacaattgaaaagttattctgatagtttaattcaggattctattcgttacaatatggcaacccaaagttttgaagggtttgctacagaatcattaaatagcaatgccaatcttttaacacgtcaaaatgtccactttgcgatttacgatacaactcaccggaaaatctttgccagtaatggatttgctcctagtatgagtaaaagtgattggaaaaaattaaaaaaaggagaaaccgtttgtactaagctaattactcctaaaattaattcacgagtatcgaagggtgcttctccacgaatgaccgaagtttcacgaccatatttctataaggggaagatgattgcggtagtatcaattgcaacctttgtatcgacgattgagcaaaatatgcatcaaataaagattaacttaataatggcattactgactgctagtcttgtaacgcttgcagttagctacttcttggcacggtcaattaccaaacgaattgatcgattgcggatggctactcaccaaattgcgcaaggaaattacaatgttgaagtggacgataatgggcgtgatgaagtggcagaccttggtcggagttttaaccaaatgaccgcttcgttacgtgaatcgcaacaagaaattcgccggcaagaggagcggagacgccaatttatggctaatgcagcccatgaaatgcggacgccattaacaaccattaatggaattcttgaaggattacagtatgatgcgattccagaagaggataaaaagcatagtatccagttaatgcaaaatgatacgcggcgtttaattcgcttggtcaatgataatttggattatgaaaagattcgcactaaccaaattgcgatggaacggaaagtatttgatgcatcggcagtactcgaaaatttacgagagcagttagcgaaaaaggcaaaagagaaaaaggatactctgcacttggatgtagaaaagaatttacgggtatatgcagactatgatcggtttgtacagattatgttcaatatcattcaaaacgcaatccaattcactgataacggaattattgacattcgaggaaaacgtgtggaaaagggaagtcaatttgaagttcaagataatggaattgggatgactcctgaacaacttgaaaatatctgggaacgatactataaagctgatcgttcacggatgaatactaagtacggagaatctggcttaggactcgcaattgtgcggcagttagttcttcttcatggcggaaaaattgacgtaaaaagtcagtatggtaaggggacgacatttacaatctttttccctgatcgtgaatacgctccgcataatattcaacctacaaataataaagacaaaaagtaagccaataatttgagcgagacgctttaactgtgataataaagcgtttcttttttgtagaccaatttttataatctaaagaaatttaaagaaagcgcttgtgaaagcgtttaccatatgatacacttatatctcgtaataatattacggattgataggagagaattttttatgaactacttacttgctttaatccctgcgattggttgggggattatgccgctgatcactggtaagatcggtggttcaacgattaaccaaatgtttggtattggtgccggtgctacgattgttgggttggttgcgtttattatcggtcatccaactgttacaacgactggattctggttctcagtactgtgtggggctttgtggacaattggtcaaattggacaattcgtttcatttaagcggatgggtgtttcaaacactattccactatcgacagtatttcaattagttggtaactctttgattggggttattatctttggagaatggcgtggagcacgtgcccttactattggtttcatcgccttagcaattgttattgttggtgctttgatgacctctgttactgatcagagcagcggaaagaaagttactgtccagaatttcctttttctattaattacttctattggttactgggtttactcagcattcccaaagatgccaatggttgctaatgacagttctttaggaattttccttccagaaatgcttggtattttacttggatctgttatttatgctatttgttcaggaaatattgattccttcaagcaaaaggaacaatacctcaatatctggggtggtatttcttggggaattgcggccttagcttatatctttgctggacgggcattaggaattaatacggcctttgtcttcacgcaaatgaacgttatcattgcaacaattggtggtatcttagttcttcatgaacacaagactcggcgggaaatgtcatttacaattgccggaatcatctttattgttgccggaagtattttaactatttttgcttaaattatattaaaactaaacttaaaaagaccttcatcggatttttgatgaaggtcttttaatatcgacattattatttaataagggaaattttccaagcgatctttttcagtaatgggacgaattactttgcctggaactccaaggacaagggagttatcaggaatatctttagtaacgactgtacctgctccgataacgcaaccattgccgattgttacgcccggacaaactgttacattgcttgcaagccaacagttatcgccaattgtaactggtttgccatattcaacgtcatcgaactgaccgtcagcttgctgccgaatattacgctgctgatacatgaggggatgcatggctgtaatgatcgagacgtttggaccgcacattacgttatctccaatagtaacagggcatgtatctaaaatggtaaagttaaaattagcatagaaattcttacctattttggtaaaacgaccgtaatcaatatgaataggtccttgaagatatattccgtcatcatgctgaggaaataggcgatcaataatcattcctcgttcaacagtatcttcatcagttgttaagttatagtcacgacaaagacgatgagcaaggtgagaaaacttattgagttccggtgttccaggacgataaggcttcccagctaacatattttcagtatttttatccatgaataattattcccttcaaattatgtaagcggatacgctgtgtattcccagtatgcctaattaaccttaaattgtcaattttcattaatgagaaaaaattgctagttctgattgaaaccgacttcattatccgctatcatttaaatgtctaaaaaataaaaatagaaagaagctattggaatgacacacattaaatttgacagtagcgcattaaagcaatttgttcatgaaaacgaacttggtgaaatgcaagcaatggttaacgccgctaatgatgaattacggaatggaactggtgctggcgccgacttccgtgattggctccatttaccaaccgaatatgacaaagaagaatttgcccgtattaagaaggctgctgataagattcaacgtgattcagatgttttagttgttattgggattggtggttcttaccttggtgcccaaatggcaattgacttcttacacaatactttctatcaagctcaaaatgcaaaagaccggaaagctccgttggtagtctttgctggtaactccttaagttcaacctatgttcatgacttgatccaattaattggtgacaaagacttttcaatcaatgttgtttcaaagtcaggaacaaccactgaaccatcaattgccttccgaatctttaagggccttttaattaagaagtatggtgaaaatgaagctaataagcggatttatgctactactgataagactaagggtgccttaaagactgaagcagatgctcatggctatgaaacctttgttattcctgatggggttggaggacgttactcagttctttctgctgtaggtcttttaccaattgctgcttctggtgcggacattgataagttgatggaaggggctgcacaagcggaaaaggattatgttgatcctgatctaaccaagaacgaagcctaccaatacgctgcttaccggaacattctttatcgtaagggctatgaaacagaattactcgaaaactacgagcctaacatgcggatgtttgcggaatggtggaaacaattagctggggaatcagaaggaaaagaccaaaagggaatctatccttcttcagctaacttcacaaccgaccttcattcacttggtcaatacatccaagaaggtcgccgtttcttaatggaaaccgttgttaagcttgataagccaaattatgacatggaaattccaacagaaccagataatcttgatggtttaggctacttggaaggtaagacaatggattacgttaacaccaaggcttatgaagcggtggttgctgctcatactgatggtggagtaccagtgatgactgttcatatcccacaagaagacgaatatactttaggttaccttatttacttctttgaggttgcgatgggaatttcaggttacttaaacggtattaatccatttaaccaaccaggtgttgaagcttataagactaacatgtttggattgcttggtaagccaggatatgaagaaattggtaaagaattacgggctaagatggataagaacgattagtataaattaaatatcatcaagaaggggaatagctgttatgacatagctattctctccttttatctggagtatttttatgaaaaaagaagaattaattgaacatcgggatcgggtaaaagatcatttagtagtatggattgttttaacaatttgtctgcaaatattaactgtttttcatatcttggcgttcttaaaatatgtagtatggctttctgccgcttatagtattttactaattatcttgtggtgttatttagaatttaagattttacatttaaaataatttaataaagggagtgggactataaacttgtttcgagtttttagtcccacccctgcaaggatggctacgacgcgaagctagcctattggggcattatggacgctgatttatcaacgttcataatcagccatctactgcgttttggcagtttacactttaaaatagtaaagaggttggattgttttcccagcctctcttttctattaaataagaccaaaacgatttcttacagctgtattaatacagtttgctaatttctctttaacctttttatttatatctaaattatcagtatcatctttaagataggcattaattatgattgaagccattacatgtttaggaacagaaagtattttaatgtccatgtatttagggttttcggcgggaatatcttcaaaagtgagaacaatatccttaccattaacactaattgttgttttccctcccttcctaactgtgtagtcaagttcattaggggtacaatttttatatgcaatcataatggttatcccttcttattattaatattattgttagtataacataatttaagttataatcgacgattgtaaattgtgaagagaagaatggtaagataattgaaaataaaattggttaagaagggaatgaaattataatgaacgaatatgtaattggggttgacctaggcacaagtgcagttaaggtttcagcgatggaccgtgatggcaagattgttgcgcaacaaagctatggctatgatctccatcagccttatcctggctacagcgaacaagatccgcgagattggctttatgaaacaacgattgtaattgatcgattaattttaaaagaacttagataatcataaccacccgtcaaacgggtggtttgcacatcggctataagccgataataaaagccggcgtctcaaggcgctggctttcgctttgctcaagccaaaatgctctgactactttgccaccgctttaagcggtgtttgtactacctcacttacccttaaaagggtccgaatattccacacttgttagcttatccattgctatatcatgtttctcttgatctcggatatacttctttatcgtggattcatttaatccaactgtactcacatagtagccttcagcccaaaaatgtcggttcccatatttgtattttaagtttgcatgtcgatcaaacatcattaatgcacttttcccttttaagtatcccataaactgcgatacacttagtttcggcgaaatacttactaacaagtgcacatgatctggcatcatatgaccttcaattatttctactcccttatatttgcacaataaacgaatataatctcttaggtctcttcggtattgattgaagatcgctttacgtctatactttggtatgaatacgatgtgatacttacataaccacttcgtatgggctaagctatttaatttattagccatatttatataacctcttttctcttattgactttggcttgaacacctacatcttaaggcaaaagaggccttttttatataatttttatcgcccacccgcatagcaggtggttttttgtttcgtgcattcgctctgctcacgcactcaactaggtctaaagacattaatgtaaataacggagaaaataaccgtcttaaggtcattttctccgttattttattgttaatttatttcttgaatcaatccattaaagaagtgttttagtgacacttgcccaccattagtacgctctcctttgagaaatgaaatttcattgtggacatttttatattcatataagttattcgcatattccaaaataatgtcgttttctggataatccatacacatatgtgcgagattattaagaccagtttttatatcgcgccgaattcgttggaaaattatctttttaccatgctcatcacattggaaaaattcttcaaaattaacctcatcaaaactaatttcccgttcaatcatcgtattaacaagtttattaattgcaggagcaccatttccggctgtaatcccaagaaaacgtaagatggactgagcgttttcttttttcttggttttcccgctaatcgtaactgtattattattcgtcgcagcaccacttacaaggtccaaaacttgaagaagacggttagacatattaatattttgcgctgctagtttaatcactgacttaacttctgcaatgtttagtggtttttcaataaaaaaatcaatcccatgttgatatgcacttgttttgacagaaggcagaattgcttgagcagtcataatgaagtgtggataatgatgactgtcctgaattttttgaataagttggaccccatccatcgttggcattgcataatcgataaacatgatatcaattcctaggcgcattgcatcatcgtaggcctgttgcggattagaagttgttccgacgacagtattattgaaatcattttcaataatattggataataaatgaataattttactatcattatctaaaatataaaaattcatgtattttcaccgatttcttgatgttgtttgaagtattttgaaacactatttaattttactctttgtgaagataatagacaatagagctgctattttacaaatgtgtagttgtttccgcttacatccttgtgaataaagagattgttgcaaaaaaacgctgaattttttctgttatttatggagcctttttgaagtattatgaaactttagcctattatagtacttgtattaagaccttaggaggaaataaaaatggcttttaatttacgtaatcgtagtttcttaactcttgcagattttaacactcgggaaatggaatacatgcttgatcttgctgaagatttaaagaaggcaaaatatgctggttatgaaggcaagaatcttaaaggtaagaacattgctttaatttttgaaaagagttctactcgtactcgttgttcttttgaagttggtgctaaggatgaaggtgctcatgtaacttaccttggcccatcaggttcacacatcggtcacaaggaatctgttaaggatactgcacgagttcttggtggaatgtttgatggtatcgaataccgtggattctcacaacgcaatgttgaaattttagctaagtactctggtgtaccagtttggaatggtttaactgacgaagaccacccaacacaagtacttgctgacttcttaaccgctcacgaagtattgaagaagccttacaaggacatcaagtttgcctttgtaggtgacggtcaagacaatgtttcaaatgcattgatgcttggtgccgctgtaatggggatggaataccacgttgttactcctaaggaattggaaccaactaaggaaactctagataaggctaatgaaattgctgccaagactggtgctaagattgttgttactaatgacatcaaagaaggtgtcaaaggtatggacgtaatctatgctgatgtttgggtatcaatgggtgaatctgatgatatgtgggaaaagcggatcaaccttcttaagccttaccaagtaacaatggatgttatgaaggctactgaaaaccctaatgttctctttgaacactgtcttcctgcattccacaacctcgacactgaagttggtaaggaaattgaaaagaagtttggcttaaaggaaatggaagttactgacgaagtattcgaaagtgaacattcagttgtcttccgtgaagccgaaaaccggatgcacactatcaaggctgtaatggttgcaactttgggtgaacaaaactaattaggaggcatttgccatggctaaagtagtcgttgctctagggggaaatgcattaggcaaatcacctgaagaacaattaaagttagtaaagaatactgcttcctcattaattgggctaattgctgcaggaaatcaagtagttattagtcacggtaatggtccacaagtgggtgccattaatttagggatgaatttcgctgctgaacacggtaaaactgctgcttttcctttcccagaatgtggtgcaatgagtcaaggttatattggctaccatttgcaacaaagtttagaaaatgaattacaccgtcgttggatgaataagagtgtggcaacgattgtaacgcaaattgcagttgaccctaatgatcctgcttttgaaaatccatcaaagccggttggtgacttctacactaaagaacaagctgatgaaattgccaaagaaaagggctacacttttaaagaagatgcgggccgtggataccgtcaagttgttccttctccactaccgatgaagattatggaacttgatagcatcaaaacattgattgacgctgacaagcttgttattgccggtggtggtggtggtgtacctgtaatcatcactgataaaggacttgaaggagttccagcggttattgataaggaccgttcaagtgccttgctagctgacaagatcgatgccgataagttgattattttaactgccgttgatcatgtttatgttaactatggaaagccagatgaaaaagcccttaagacgttaaacgttgcagaagctcaaaaatacatgaaggaaggacaatttgctgctggtagtatgctacctaagattgaagcatgtctttcatttgttgaaggtcatccagaacgagaagcattaattacttcattagatggtcttgatgatgctcttgccggtaaagtcgggacagttattcgtgataactaaaaagaagatggttaggaaaataaaatcctgaccaccttcttttttagttactctttaattttttctgtggaatgcgaatgttaatcgcaagtactgcaacgataactaaaatcgaaccaaggatatctgctcccgtcatttgtaaatgaaaaattaggactgaaccgattgttgctgataaaggttcaaatgcatccattaaactaaatgtagttgcatcgatatattttaatgaattattagctagctgaaagggaattaaggtcccaattactagaatgcctaacacatataaccaaactgaaggaacgttaggaatatgtggttgactagggtgaataagcactaaggttaatccggcaaataatagcccccaccccgtaataattaatgagggaactcgaccttcgcgaagcatattttgtggaattaaggtatttgttgcaacaccaattgcagaaattaatccccatattagaacactaagcgtcattgctaaatggttaaattggccatgagttgcgataataaaaacacctaaaaaggcgataattgcactaataatttcaattcgtcgtggtggcaggtgtcgaaacatagcttgataagcaatgatgaaaaagggcccgatgaattggagaatggttgcgatcgaagcattcccatattggacagccataaagtaagcatactgaaccggaactaacccaaaaacaccatatgcaaagataatccatgcagaatgaaggtccttaaaaatttgaaagggatgcttcccacgaatttggcttaataagactaaaataattccagctgaaaccattcgaacctgcgttaaccacattgatgtaattgaactactaacattaaaaagggccttcgcaaaaagccctgaaataccccaaaaggtacaggcagtaataatcatcgctgtacctaaaacttttttatttgacataaaaatactctttccaattagatttgctattttattttaccataccaattctgtgaagagtgagctcgactttttaattatgactatctgttggaattgttttcggcgatgattggttgtggagttcgtgaatataaagccttcacagcctctatgtctcgtgattgaatgggataatatgatccagctggctgcatcacagaaatcttgttcgtgtgctgtagaccaattgcatgccctaattcatgctcagcagtatttacgattcgttcttgtgagtagccaaaggcaggatttaataggtaataagaatttagctctactgttgcgtgcagataatatccagttgcggaattcatgcttgtattggtaagtcccgctgccccgttatttggatcattaacagcggaaacactaatatttgcattcttatcattaacgattttaaatgtgaatgccttcgtgttattccattgggcaattgcggtttctgttgcattctttaatactggattactgatattaacatagatcgttgcagagttttgttcccagcgtgcatcagcgggtgtatcttgtgccccagtttgttggtcagcgttttgtttagttggggttgcaacttctttaccggttattcggtgtagccacgattgagtaagcacctgagcattatgaatgccaatattaaattgttcttgaaaggtagaattattttgataaaaccaaataattccgccaaagagtaataaataaaataaggttaataagaaattggacttcttaatcggtcacaccccctagtattcaaattctaattaaaaaagagtaaaacgtccattatttaatattttttctttattgttgacaactgtaaactttgatagtatgctgtacctataatatgattacaattgtaaactaaaagaaggtggaaatattgagaattgccgttataattattgccctgcttttgattgcatttattgtttggtggttcttcggaaagcatacagagtcggcgggaaaatcaactattgttaatgatgagcaaactgcaacgattgtcgttaatggtggttattctccatcaaccgttatcttgaaaaagggaattccggctcaagttaactttgatatgcatgactcgacggcttgtttatcacatgtagtatttgaacagctaggagttaataaggacttaacaaagcaaaagattacgacgattaatattccaacagataaagcccagacttttaactttgcttgtgggatggatatgtttcatggaaaggtgattgttaaataatgagtattttttcaaaagatcaaactaaaaaagttgttgttaatgcagaaaatcatggctacaaaccagaaacggttactttcaaacaaggaaagccagcgcaattaaaatttatcccctccgataacatgggatgtatgaatgaagtcgtctttaaggaacttgggattgatgagaagttagacggtaaaaaagaagttactgttgatattccaactgacaagccgggaacttataactatgcttgcggaatggatatgtttcatggaaaggttgttgtaaagtaatgaagctcacaaacattcagcgattttggatttcatttgtattatcaattccgatgttaatacaaatgcttgcgatgccttttcactggatgatgccagcctataattggatagcattaattactaccactattattatggcaatttcagcatttccatattggaaaagtgcgatcgctgcatttaaaaaacatagtgcaaatatgaataccctagtcgccacaggaacagctgtcgcttatttttatagtatttttgcgatgataactgatagggcggtttattttgaaagtgctgcttttgttactgtctttgttttactgggggatgcgatggaagagaaaatgcataacaatgcttccaatgctcttggtaagttgatgggccttcaagcaaaagatgctgaagtcttaaaagatggtaaatttgtcaaagtaccactcgatcaagttcaagttggcgaccttattcgggtcaagccgggtgaaaaagtacccgtagacggaacaattctggaaggggtaacttctctggatgagtcgatggttactggtgaaagtatgccggtaatgaaaaaagttggcgatactgttgttggttcaacaattaataataatgggacgattacttttaaagccacaaaggttggagcggatacaatgcttgcccaaattgttgacctagtaaaaaaagcgcaaaccagtcatgctcctatccagaacttaacagataagatttcaaatgtgtttgtcccagcagtaatgattattgctattttgacatttatgatttggtattcctttgttggcgcaacatttgttcaagcattattatttgctgtttcagtaattgtcattgcttgtccgtgcgcattaggtttagcaactccaacagcattaatggttggtactgcaagaagtgctaagatgggtgtccttattaagaatggtgaagtccttcaagaagtaagtaatattgatactgttgtgtttgataaaacagggacaattacggtcggcaaaccagttgtaactgatattgttggcgatgctaaaaaagtattaacaatcgctgctagtcttgaggaatcgtctgagcacccgttagcatctgcaattcttcaaaaggcaaaaaataaagagatctcaccagtaaaggtagataaatttgaagcaattgaaggtaagggtgtgcgtgcagattataatggacaagtagcatttgttggtagcaatcggcttttggttgatgtaaatatttcccgggaaatggcatcacgtgcggaaaaattacagaacgaagctaaaacagttgtttatgttggtcttgatggggaaataatcggcttagttgccattcaagatgttccgaagtcgagttcaaaagatgcaattgcggagctaaaagcacgtggattaatgactgtgatgttaactggggataacaaacgggtagctcaagcaatagctgatgaagttggtatcgatagggtaattgctgaagtaatgccgaatgataaggctcaacaaatcaaagaacttcaggacaagggtaaaaaggttgcttttgttggtgatggaattaatgatgcccctgctttgtcgacagctgatgttggaattgcaatgggatctggaactgatatcgcaattgactctggtggaatcgttctcgttcaaaacgatttgcgaggagttgtccgggcacttgatatttctaagaagacctttaaccgaattaaattaaatctcttctgggcgctcatttacaatgtcattggtattccaatcgctgcagggctatttgcatttatgggctttactcttagtccggagcttgccggcctagcaatggcctttagttctgtttctgttgttagttcttctctgctgttaaataaagctaagattgcgggagagcatgttgttcaagcttaaactaagattataaggagttaagaaatataattcttagcttctttttttgttatattttgcacaaagtaaaaggattttgcggtaaaatattaataaaagtgatggaggagtatttaaaatggcaacagcatttttggttcacactcaactaaactggggaaaaacatgtgattatttaattgctaatgatgttgagccggggttaatgcatcgttatgagacacgagaagattggcaagaggtgattcttgatgcattgatcaatgttcccttagcgccatacttgccaagtggtcagcccattccgccaattggaacggcaaaagtaataggggtagaagcagttgatccggcacgggttaaaaaaactgtgcaacggacacgaagccaatttataatggcaactatctggaaaaagcagtcagccttaaaaaactataatttcttacatcatgattatgacaagtggacgcaaaaacaaatttgggccgatgttgattattggtgtgactctaaaaaacatcccgttatcgatttgattacaaaatggcgttgtgtccgtcaacaccaacgattacgtgctgaagagaaatgataaaaaagagttgactattaagccacttccatgtatagtatatatcgttataagtttatcttattgggcattcgccaaactggtaaggcagtggactctgaatccataatttactggttcgagaccagtatgcccaacttctaacaaaaggcctgctagattagctagcaggtcttttgttgataaaaaagttatttgttataattacagtcaagtgaggggacgaatatggctagtaattctgattcaatttattatgttttaacaaaactaaagcaccatccagagttaatcaaaagcattagaccacgttatactaatacggttctgattctttttgatgactccttaaagatagccgatgcttcattttattttcctgttgatcgttttatggtcaatcgtttgtcaaatgattttgtggcaaagaatggtgaccttcttgatagttatttttcaatgaccaatggaacaaagaaaaattaccatgatgtttgggcgacgacctgtcatattccagaaaagaaagtatatttattagaattatcatttgaataacgcgatttaagctgcgacaaaaggtgtcacagcttatttgctataaagagagagttttatagtgcttgtttcaacgattgttttaatggtagcggcagttttaagtagtattatttccagcttctttccgcacttctcaattaattatattagtattttcgtcggcttaattattggttcagttccttttttgaatggtcggatttcctcccttccacaaagaaatatttatgtatatagtagctccactgatttattttgagaggcaatcaacgagaattaatctgattggaaaaagattacgacaaattcttgaaacggctgttcttttagtaattgtcggaacggtatttgcgggttttagtgtatcgcttttgggaattctgctagccctggcatttctgatgggtgccttaagtactccgaccgatgctactgcaactgaatctgttttggaggggttgattgtccctgaaagacaagaaaatattctaaaaatggagtcattatttaatgatgcttctggtattatcctggttactgcaatggcgctgtgggtaaaaaacggacagttcaactatcaacaaacgttttttgactttttgcgttcagctggtggcgggataattattggcattatggcagcccttgtaatgatcagttttcgtcaatttttagggcgaattaaccatgatgcttataatgcgcaaatattattatttgttagtacgccattctttatttactttatagctgaagaattaaaagtatctgggattattgccgtggtttgtgctggtttaatgcagaatagcgaaagcgttcgaagtcgttttataacgcctcgccaatttcataatgggctagtgcttttaaggttgctgcgggaactcttaaataataccatttttgttattttaggattattggttgtcaggatcattcgtgatgacttgattattgggaatacaaattcgcaatggattgtgattggtattttactttatattactaatctccttgttcgttatctctatggactattttcaaagatgggtaataaaggaagtataatttttgctcttgggggagtccgtggcgcagtaacacttgccttagtatatatgattattaacaatgtaagctctgcacagtttgatatgattgtgttggcagaaatgcttgttattattttgagtatggtggtgccttcaatcgtatttcgctttattcttaactatgatatgtcaaggagggaggccggcaaacaagttcagcgtttacggcaagaaatggttaaagagggattgaaagcagtagaaaaaatatatcttccagaaaaaattagagaaagtgttgtttatgatttgcgggatcaaaagagtaccaattcatttgcagatttttggcatcaatgggctaaagcaagtcgctatccagaattcaatgagcaggaaaaggaactggagcaacgagccttattatgggcattccaagctgaaagacagtaccttgatatggtatctcaaaaggaaaatcatcgtgactatctttttgagttttacaacgaaattctattggcagagtcaattttacttaacactgaaaatgaatattaaattaatttgattttaagttgacgaaaaattgaaattaacgtatacttttaattgtacgttattgcccgctggtcaaattggttaagacgtcgccctctcaaggcggagttacgggttcgattcccgtgcgggtgatttttttattttaaactaatttaatatagcgtctaaatcattgataaatcagcattcttgattttaggtttacactataaaacgttatttttaatcaattctgcggaaaaattgcggaaaaaataattcaacttgtcagcatggtggactactaatctagtagtctttttatttttgctgtcagaatttttaggattaaacatccccaacaatattttttgtctaaaacggggatgatttaattattctagttaatgtaattgcttatatatcaacaaccaattaaaatagcccccctacctaaaaagtttcaaaacagcctttgcaaataaaaatacggtaatgtgtgccgctctcttctcaacaatgcagggcggggggatgttataatagttttgcttatttttatatcgaaggggcgctctcgcagcagggcactttttttagtgcaatttaagcagtttttgcagcgtaaataaaaagacaactaacatatttcgccagctgtcctcagtcgtttaatttttcttgtcgttgtttgatacagcctaatagcatatcaaggtcttcttgcgttgcactctttaagataaagttcttagcaactgaacggcggttaatatactgtacctgcgccttgttcttgctacggtatttgttaattgctttgtgctgtgactctgtaagtgccatcttatttcctctcaatcttaaattcaaatagcttcttgcgtttgtcttttggtgtgtgaagccacgtcttgaacttcctaacgtcttgtttccacattgctagcgtttcacgtggagagtagacatctagggaaatagtaacgtgtttattctttgactggtatttaaggcgcttcatatttcatccctcacttttgctaattattcttgatttaaagaacgtctaagccatgctataatatacatatgaaaagcccctaagagttgagctaccaacttgcaactcttagggcggtgattaatcaccacttgatttcaagttttaagtctagcgatataaagattttgagctttaatctaatctttattttgctaggctttttctggatatctgtcaactggtatggttgactaaaaatacttcctacgaaaatgtagggggtatttttttacgaaaaaatacaatcgattcttaaaaagaaaaatttttgattggcaaaaccataacaagttcgttttagagttttgattttgcgattgatgccttctaaaggaccattagagtattcaaacttagcactatttaagacatattttctgttttgacgaagggtttggatagcggtatccatttctgtattggttttttggtagtctaagatggttgactctagtaattcactattgcgctcgtttagggctttcgtgatatcttggtaagtttggtatacttcagcaaacttggaaaatttactagtaatgagatcaacagcattttggcgagtcatatattgcttaacgccgcgaagaaaaactacttcttcagggtgaagatcttcagctttttatggaatagcttccaatgtgacttcataattttatattctcggctctgtttatcaagttgttttaggatagaaatacgacaattgtccaaagcgcgaccagctaattgcacaagatggaaacgatcaataataatgctggcattagggaaaaggcgatagataaagctttgatattgagcatttaaatcaatcacaactgattggacgcattcgcgttcggcttttgaataacgactttcaaaataatcaataatggtaggtgatagacgatcctgtaactttgtgacaatttggtgggtttcagcgtcacaacagataaaggacatcacagacttagttgaacgaaactcgtcaaaacatagatgcttaggcaacttagctacacgatagtgtggttccatgcgctctaaaattgttcgacgaacactgctaggagagcagtgacacatttcagcaattagctgaccagatagtcctttacgagctaaaagcatgatttgatttttgagattactggatagggtttgattttctttggttaaattagtaatagcaccaaacgtagtatggcacgatttacatttatagcgttgtttacgaagctctagttcatatcttctcccgtttaaactagccagtcgtacatgagttttgcgaaagccatccttattaactgtgggaaagccacagttacgacaacgattaatcggataagaaagagtagccgttattagtgttatatactctttaacagagtcatcgttgtgttcagcttcttcaacagaaataattttaatatttttatctttaattccaagaatatttaggatagaatcattatgggacatttgtttaaccttctttcatgatttttgtggtgaattgattgtataacgaggggacagcaaatgtctctttttttatacaaaaaaatctggcatggaatctccatccataccagaaagtgtatacccctttttctttactttcaaaagcaatttaaccaccccctttccttaggggctaagtatattatatacatatgtatcaacggtgacaatagggaatactaaaatatttgaaaaatatgctagcatttgcaagcattagatacctataaaatccgagcatttctgagcattttaacactaataaaatcctaggatttcctaggctttaaccataaagctagaggctttcaagtgctatcaaaatagggtgcaacctttttgtttttgtatgcatactttttttggaaagtacgcatactttttaatgagggtgcgcaccaaattatactcaagataatatgctaaaatacctatggggcgtgaaaagtaaagttgctaatttttcgacaataccaagagtagcttgtgagggctactctttttttgtgctaccatttgcaaccatttctcaactgggttaagcgattttttgctcttgtgctagtgatattaatttgtctaggtcgtctttatctgcatagtgtttaataaacgttttagcatttgagcgatattgatatagtttgtttttctctgggtgtcgtttcttgtatcgtttatgttatgctcactgccctactccccttgtgatataatatatttgctattttttatatcgaaggggcgctctcacagtagagcgtctttttttgttggaatttatcgtgcaaaaaagtcgatgtgcgttcctaaagtatcaataaactaacccccgttgaaagaaaacgggggcttttttagtatggtctattttaatagcaaaagaggggcgaatattgctctttcttgcttcttgttttgacgttaaatgtgattatatcaatgattacagctaatcactcataagcaataataattaactacgaattagctaacgagtataagtttttccgatattgttttaactacaaacatccccgataatgtccaattttgggcaatgatttctaattaagattgctgttatatcaaccttttagatgaattgataaattgcacattacatggaacatttactgtttcacaattccaatgtttttatatgcggttgttaccttgttctggtagtaaccagtataaaagcgatggtgcttttgataaacaaagcctaacaattccatattgtgcttgaattggcggttgcttaatggaattatggcttgctgttggcaatattccttgtaatggttatataggacacggcaagcacaataaaatctgcggtctttttttaccccgtcagagaaaacaaaactaacaaccgttgggtctgctttgcctttatttctaactctgaaatgataatctttcttactttcagccatccactgtgctaatgatcgcttactaaatacataacgcccacgataccaactcatttagaaccatcccctttgtactggtctttcatgtagtgggtgaatagccatataactgcaatatcagcgataagactagctaaaccacaagcaatagcaacaatcaataaacacgatacagcgaacatttaaatcaactccatttctctatactctaattttcattttaaagccgtctaagccgttttaacttgcaaatgaataattatattaaacagacgctatcggctttaaaactgctgattatttttaaataagcagggttctaatttaatacgttatatatttttcactgtcgagttttcgacaatgagttttcgtggctgaattttcagcagtcaaactttatacaagttccttttccgtccaattgataatgaaaaattacagttgaactattgatatatcagcatttgggctagtaaagcattgcacgcttttaaataaaaagcatcccctttatatcgctgtattaacagtaaataggggatgttatttttcgtaggtcatacttttttaagacagacgataatgctaaaaatgattgttaattagtgccactcgttatggtctaggctgttcaccttatccaatagactttgggcgttttctttctgttcctgtggtgctgtagggtcatttagtattgtagtggctgccactcttacagcgtaacagtccatgagcacttgattaccttgtactttgaaatgttcatctggaatatgagccacaagaggattttcagccttaaagcgttcaattggattgttcccagctacttctactaagccctcgttaattgctcgctgagtaggattgcctaactcgtcaatcatcccctcatcaactagcattttatagagtttgtccttgttaggacgcaagccaatagaaagaaaatgactgtaggcttgctcaactaacggtgggtatttgatgttaaaattcattgtttgtcctttctttttaagggtgtctaatctgcccaaactgcttcaaatatttattagctaatttatcttttgctttgctttcctcgctattgcttcttagataatcgcttctaatggtctttaattgcttttgaagcgaactagaaagtttcttggcttttattagctttcgattgtatttaattattaattgcctgttttgtttgagcagggtaggcgtttgatgtttgaagatacctagaccatcaacaaaatacaagtgggtaaatggtatcttgattaagctatcgtttaattgcttctcgttggcttgtattaggttgtctaatcgtttaatatcactcatcaatttagtataggtctcatatccagtactaaaatcagaaagacttctctcaaattctgttagattcatgaagatcactccttagaaaggtaattcatcatcaatgttcttctctttttatttaggatactcattcttgatgtaggacaaacataaattatcggtttctggagtaatacttgatttttcttttatcactgtgagggtatcttttatttcgtcaatagatgatacttttaattcatttgagagaaagtaaatcaattgatcgttatttgtactaaatgttgttttgaattttgaattaatgaatttgattagttgctcaatttctttttgattaacagtagaagattcttgtggaaggctttctttttctttatttatattctctttatttatattatatttatttatattggaggcggatttagtacttaaaaaggctgttttaggcttttcccgcctatttccgcctgcttcgttagaatgtgtgtcaatcccttgtcgctctagggcttgaacgtcattattttggggtgaggctttttccgcctttttaagcctattttcgcctattttatcctccataactaaggcgggtttaggactatttgaggcggattccgcctttatcaatttatttcttgtttcttttaaattttcaaggtcaatacctgtctttttgctattatatttgtggagaaaatcattaagtgtcattgcgacattctcatcgtttaaatttgttgtgtatctccagtctgttctaatataagtgattttagttagttctatttgttgagtgttggtgtggtttttgaggtcttgattatttaaccaatcaacaataatgacaacactatcggatacaatgataagaccagctttttctagttcttggtaattcttttcagtgaagtgattgagtacattaatcattgttagttcagaacaaaagccgtcatcatccgcatacaagactaattcatcgtataagtagcggtcttccactgataattggagaaatttattactttgatgaatactctttgaaattaatcttctatttgccaatttaagatacctcactttacataactgttattggttcatcaaactcgctaatttttattagaccagcatcagcaagttgagaaaattcttcaccatttacatgtaaaacatcgcatataagctcactacaatagacaaggttgtcagtgttcttatatgctaaaagatacagatacagtaatttagcgtcattgctaagattgtaaaaatcatccgtttctaggaagtcttttaattccattacttacatacctccatgttcttataacttaattgcccgtcaataaatagctttgttaaagcgataagtcgtttaagcatttcaacatcgttatttgtgacttgttcaatgcgttcaacaatcttttggcgttctcgctcttctcgcttgttgtgcgctaagtaatttggattgttaagcgacttcataatgaaataaaggcgagtggtgtttttatcatcgttgttcgttagcaaggacaatttagaatataagtcaccattgaagccgtctaagtaaactaaaaaggtgtgaacttgcttaatatcatccccaacgaacttactaatacgggtggcgagttccgttggttttttgctgttctcggtgtctttaagatatgaataccacgagagcagggcgaggtaagtagttttcatgtcccaacgttcacggtgtccgtctggggctgtaagagtaactagttgcattctgtatcaccgcctttgagttcaagggttgctaattgttgtagtacttctaaatcattatcatttaggcgctctaagcactcatgtaaagcgctgataatatcttgctgatacttaactgttaagactaggctaattaaatcattgtgagtgtaatcatccttcagccactagtgtttgaagttcatcaagtgtttgtggcttagatgaatgcgctagccaaattgctttaaagtcggcccaccagtgctcgataactgcgttatctgctggtgtaccaggagctgaatagctatgttgactattattgctagttaaatattgattgaacgccttagaagtataagcagctccgcgatcagtatgaataagtggggctaatacaccttcttgtttctgagctttcttgaatacttgaattgctccctcactagtttctgttggggtaattagccagctaattggaaattgaccatataaatcaagaaccacatgtaaacgaactttataattatgaatattgtaggcgagttctgttgtatcagttacccaaacctgattagctgcttcctgtttaaattgacgattaagtatattttcagcttgataggtttgacgttccttgtcgcgttttcttttagcttgacgatagtcagctttaatcccatgttccttcataattctaataactcgttttttgttgaccaaatatccaagacctgcacgcttaataagacgagtcattttcccatagccaatactttgcttattagttttctcaatttctttaatcaaattaaggatctcttgatcctggatatccttagtagttaattctcgttttagccacttatagtaggcttgccggcttactttagccgctttaactagttctgatactgtataaccgtctttaatcatttcttgaatcgcttgatatcgtccggtcgatgcacctcccgattgcgtatttcgactaatttttttgcgaacgcaatttgtacctcgctttctcgtttctcagcttctaattcacgtactcgttttctcaaccgttcgagctcatttgtcggttctttatctttatttctgccacgattatcttttagtacttcccaattatgatcgtgcaaatatttacgtacccacgaataaacccgctgataactaatatcatacttactagctgcttctttatagttgttctggtggttaatcgtccactgcacaatctgctttttctcatcaaaggatactttccggcccattttcttaactcgctttcttgttgcgtaagcaacagttagtttgtcactattgtactggataatccattgttttagttgagaaatatggcgtattttgtacttaattaaaacctcacgactagccagtccgttaagctgataatctttcaccgcggcaatctttgtcttaagtgaatatttttggttatgtttaggacgaattaatcctgccagtcctgctaataaaaattgtttaatccatttagtcatgttcgctgttctcacttcgtgatagtcagcgaatactcctaatgagcaatctgaatcctgataattacttagtaatcttaatttttctgttgtggaataactagaaacgaaaaacaccccctagaattggcacttttattatttaaagtgtcaaccctaaagggtattgtacgaatttaccattagcggtttattccttctgtactcctttttgcgttaaaaatattaattatcataattgccggtgattgggttcatttcatggatttggtttgtagtggggtcatattgataggtaccagtaagatgagctacatttggatcgccgccttggttattgcgaacttcaatttgataattattgttttgattattcttagtcatgtaataatgattgccatcttgttgaatgccacttgtcttcacaaaacttgttaggacttgttgatcattttgtgatgaggaagtagtagttgctgattggctgctaggattactagttactgatgaactaggagcttttaccgtttgattagttgattttgctgaactgttagttacctttgaatttgcgcttgttgagcttgtatttgttgaagaagtggactgtacactagtaggtgtagatgtggaggcttgaccctttgctttttcgctactagtagaggaggccgccttcttacttgtttgttgacttacttttgtcgcggaagtagatgtttttgttggggctgctgcactattcgtacacccagctagtcctagggcggctaaaattactaacgaacttgctaaaactttatttgtcatcttcatcattttaatgcccccctcaacttctcttttttataaaattcttataactatattataccgtcttttgaaatgattttgtaatatttttaacttatttgtcacaattaaccaattatgtttaataatttcttagatatttttcctttgtctgatttacgttaaaataaactctattgaggaagtgaattaaacgatgaataaatacgatttaacaattaccaaattacatcaaatggttaaagaaggaattgttccgggagttagctatgtgatttttgaccgtcaacatacgattaaggaagtaacggggatggctcaagtgtaccctgagactgaattattaaaacctggtatgctctatgatgtggcctcattaacaaaagtaatagggacagttccagttattgccatgcttattcaaaaaggagcattgtctttagatgatccgataaagaagtatttacctgaatttaatgataaccgaccaactattcgaaatcttcttacccatacttctgggatagctggttatattccacatcgtaatgagttaactgcctctgaactaaagacggcttttttgacaagaatgcaggtggaggatagtttgaaccatcaaatcaaatatgcggatgtgaactatttgtatttgggatggattattgaacgaatttataatcagccggttcaaaaagttattgcagaacaggttcttaaaccattaaatatgccaactgcgacatttaatcctcatccagctaactgtgtaccaacagaagtacaagaaaaacgtggcttgattaggggagaaactcatgatcctaaggggtatattttaggagaaagttgtggatgtgcaggcctctttgcatcgttgaaagatttggagatttttagtcatgcgctgattgaaaataatttaaatggtcttcttacttctgaaacaattgatcttttttttacagatcaaacacgaattcctggtccgcatagccgttcgctgggatggaaactatttcatgctaaagatcatcaccttttgattagccatactgggtttacgggaacttggatggtgttagatcgtcaaactgaccaaggctttattgtattaactaatcgtgttcatccaagtgccaaaaaccaagaatttttagctgctcgtgaccaactttttgcaatttatttaacagaaaaagaaaaaactttgtgaaatttatatgcaatcaattgaataaccgctttcacagaatatgcgctttaggggtaaaaaatgtataaagactgttgataatttatattaataacttctttttatataattcactaaatattgatttgacggcatttgacaacgtttacataaactaatatgatgtagttgtagtcaagtgatacttcaaaaaaggagtgatattgtatgcaaagtccaattcatgttacatcagaaattgggaagcttaagacagttatgttgcatcgaccaggtaaggaaatcgaaaatgtttatcctgaaattcttcaccggatgcttgtagatgatattccatacttaccgatcgctcaagaagaacatgacctttttgcgcaaacattacgtgataacggcgcagaagtcttgtatcttgaagatttattaacagacgcactggcagatgataatatcaaagatgaattccttgaaaagatcatcgctgaatctggttatgctgctggagcaatccatgacggcttaaaggaattcttgcttagtttcagtactaaggatatggttaacaagattattgctggtgtacgtaaagatgaaattaaaacaaagtatgcttcgcttgccgaattagcagaagataaggattacccattctatatggatccaatgccaaatgcatactttacgcgtgaccaacaggcatgtatcggggatggaattaccattaatcacatgacctttaaggcacgtcaacgcgaatctctctttactgagtacatcattaagcacaataagcgttttgctgacaagggtgttgaagtatggcgaaaccgttatcctgaaggccggattgaaggtggagatgaattagttctcagcgatcatgtattagcaattggtatttctcaacgaacatctgcaaaggctattacagaattagctgaaagtctctttgaaaagtctgattacgatacagtaattgctatccatattcctcacaatcacgcaatgatgcaccttgatactgtgtttacaatgattaactatgatcaatttacagttcatccagcaatcttacgtgatggtggacatgttgatgcatacattatgcacccaggtaataatggtgaaatttcaattactcatgaaacaaatcttaaagaaattttgaagaaggcacttgataagccggaaattgatttaattcctactggtggcggtgatccaattattgccccacgtgaacagtggaatgacggttctaacacgctagcaattgcccctggtgtagttgtaacttatgatcggaactatgtctcaaacgatttgctgcgtaagcatggcattctcgttcacgaggttcgttcaagcgaattatcacggggtcgtggtggcccacggtgcatgtcatgtccaattgttcgtgaagatctcaagaaataaataagataatgaaagcagcaaatttatctgagtaatctagaaagggtataattttgctgctttttcttgtatcattttagtgtaatcaacatgataagaagggaacacgaatggatcgaaaggcaagaagaaaatatattgaacaagtggttaatgatcgtaaaattgaaacgcaagaagaattgcttaagtttttaactgaggcgggtttcgagacgacacaagcaacaatttcaagagatattcatgcgttgaatatcgttaaagcaaatgatggcgatggtcatacccattatgttcaacttcatgtgacacccgaacataattttgaacgattatatcaaggaattcatgataatgtgcggacaattgaaactgttcaatttatgaacgtgatcaaaactgcactaaattctagttatgcgacgattttggctggaatgtttgatgaacttgatattccggaagttgtgggcacacttgctggaaatgacaccttgattatcattagtaaagataatgatgatgctaaaatggtttatgacttaatcattcaacacatgcattcataaactgcataggagggatatttatggatgaacaaaagaaaggtattggtagaggcgaattgatcgccttaattgtaagttcatgtatcggtaccggaatatttggtattactagtgatgtggcagcggcggcggcaccaggtcctgccctgttagcttggatttttgttggaattggttttttgatgttagttctctcgctaaataatttatctgaaaagcgaccagatcttacttcagggattttctcatatgctggtgccggttttgggccattaggtgaatttatttctggatggtcttactggttatccgcatggctgggaaatattgcttttgccaccatgttgatgagttcaattggaacgttcttcccaacctttaaaggtggtcaaaatttaccatcgattattattgccatcatcttctgttggctattaacaatcttagttaacaatggtgttgaaagtgcatcttttgttaacatgattggaacaatctgcaaggttttaccattagttatctttattattatgatggttgtttgcttcaaggctgggatgttcacagcagatttctggggccgagttgccaataatgcttctcacggcactacaactgggtctgtttgggaacaaatgaaaggtaccctaatgaccttaatttgggtatttatcggtgttgaaggtgcttctgttatggcaagtcgggcaaagtcccttacagccgctcgtgaagcttctctcatcagttttggtcttttagtagttatctatgtattaatttcaattttaccttatggtgcattaactcgggcagaattagccggcatgggacaaccagctattggtcatgttcttcaagcaaccgttggtagttggggctcaattttaatcaatgttggtttaatcatctcaacaattgtttcctggctttcttggacaatgctcccagccgaaacaacaatgttagttgccgatgataaggcaatgccaaaaatctggggaaaggttaatgccaaaaaagcaccaactgcttccttgatgattacagcggtattgcaaacaatcttcttgttctcattgcttttcactgataaagcctatgaattcgcatattccttatgtagtgcagcaattttattctcatacttatttgttggactttaccaaatgaaatacagttctgcacaccaagaatggggacaatttacaattggtttgctctctgctgcattcatgttcgcatgtatgttccttgctggatggcaagaagtcttattagtttcaattagttttattcctggattctacatttactacttagcatgtaaagaaaataatcgtaaagttacaactgctgaaaagtggacaatggcgctaattttaatcctaagtgttattgcaatttggcttgttgctaatggaactattgccatcggctaggtaaataatgtataattattccacatttcaagaatatttataagtgaggtgattaaggtgaaggaaaagaagttaaatctcttcctcttaatcaccttaattgtaggaacgattattggtggtgggatttttaatagtccgaccgatttaattttgaaagcaaatccaatggctgcattagttacctggttaattggtggcttcgggattttgatgctagtactagttttttacaagctttctgttattaagccggagatgaacggtggaatttatacttatgcaaaagaaggctttggtaactatattggttttaactccttttggggatattggatgggagcagtttttggtaacattgcctttatctcgctcttttttaagaccttaaatagtatgctcgggacgcatcaactttcgccattaatgtgttttatcgggggctcaattattctgtggggatacactgcgattacatggtttggtgtccgcgaggcaagtatccttaatgccgtcattacgattattaagatcttaccgcttttattagttgttattgttggtgtctttgcattccagccgcatatttttaatgttcctgattggacaaacattcttgccgttaatcaaacgcaagtcccatttaaagaccagattagtggtgcgatgagtactattgtgtggtgttttgttgggattgaagcagctgtttcaatgtcacgtcgggcaaagcagccacgtgatgtggggttagcaacgattattagctttgtaattgtattggtcctctatatttcaatctctattattccaatggggattctacctgctaaagaacttagccagacttcagttccactggcagcagcgcttagtcatacagcattaggaatagtagggagtcttattattaaaattggcttactgatttctctattaggggcattattaagttggtttatgattggaccagaaattgcatacgtaaccagttatgatcgggatatgccgcgagcatttaaacttgttaatcgccatggtgttcctggctttgcattaattgtatatacaattattatgcaagtatgtttactagttttactgcttccacagcttcaaatggcctatacaattgcatatactttagctgcgacgatgaccttagttgcttacctgctctctgcgttatatgggttgaagctagcaattagcgaaaaaatgggccttggctttaagattattgctacgttagcttctctttattccgtctatatgttagttgcttcgggacttgaatatgtatttgcaagtgcgattatttttgcgctaggaataccattatttgccggggctcctaataaaatgagtaagaaagaaaggtggttagcaacaattattgccttagcagctgtgattgcgctgatgttgattattactggaaagattaatttttaaaaattaaaagggatgaggttagaaggaatttttactttccttcaatctcatccctttttgtattctaatcttcgctagtcatcttacttttcatgttatccattcgccagacaacataggtttcaatcaatgtgattaggcttacccataaaatcgtgaaatttgatgaagtaagaaatagtaagatgattaaaatccaagatatccagttccaacgacgctccagacggataactttggcaaagcgtggtgggattctagttggattttgaatggctagtgcttgtagttgggagaaaagacggacttcccaaaaactttctagcaaaaaaataatggtaaatacaaatgttatggtttggttcactgtttgtcaccttaattaaaatgtaggtttaatttttagggctttttgactgcttaagtcggcatcggggtatttatgctcaagagctgctaaaagaatctttttagcaatctcaccatttcttgtaagaatgggaccgtggaaataagagcaataagtgtttttatagattgctccttcggtatgatcttcaccgttatttccattaccagaaattactttaccaagcggacgctcaccttttcctaagaatgtgcggccgttgtgattttcaaagccatggtactcttgattgctttcttcgtttttgatggtaatatctccaatgaaccggtgattgtcttgacttaaagtatagtgatcaaggattccaagtcccggaatcttttcgccatcagcaccgatataatagtggccgagaagttgataacctccacaaatagcaagcagcggctttccatcattaataaacttgtcaattcctgcttttttgtttggaagatctttggagacaacaagttgttcgtaatcttgtccaccgccgaaaagagctaaatcaaaatcttgtggattaaagtcgttgtcgatactaatgactttgacatcaatatcggcatccatctgtttagcgtaatattgaagggcgataatattaccgacatcactataagtatttaataaatcgccgtagaggtgggcgaggtgtaagtgatattttgccattagtccattcctcctttaatatagcccttttctgctagttgtttccgcaattgcagaacggctgtatatgttgccagaatatagacgtgttcagttggcatttccttgattttatcaattacctgggtaaggtccggttcatgccacatatcttttacgccagccattgttaatctagtggtaatatctttataccgttctcctccagtcatgtattgtgggatttgatgttgggtaagtttttcaaagtcgccgtcccagatccagctagtatcaattccatcagcatagttagcatttagtaagaaggcaaagctaaagggcttgtcatctgtctcaatcatatccaaaacctgattaaggccaactggatttttaactaagatcaaagtaacttgttttccatctatattaatgacttcttggcggccaaaaactcgttcatctgattcaaaagcatctttaatttgtgcttggctcactccgagaaaacgaccaagagagtaagccgcaagagcattatagatgttatataaaccaccgattccgatggtgtatttttgcccatcaatttcaaaagttgaatgcgtgggggtaagcttatcaattttggtaacagcatacgttaattctggtcgatggaaaccacaatttggacagaagtagttgcctagcccggcataagttcgcattcgatactttagaatgtgttgacatttaggacaaaggagaccatcagtgttagctggggcgttgaaaggctctttttcttcgtggttaaagccataataaatgattgggttaggcaagtctttgctgttaaagagctgttcatccccgttagcaatgatggttgctttcggtgctaatttaaccccctttaagatcttgttataagtggtgtaaatttcaccataacgatccatttgatcacggaaaatgttggtgaagacaaaggcaattggggtgatgtatttacatactttaactacattggcttcatcgacttcgaggacggccagcccttttttctttggacggggggccgtaataaaggtagttacgattccttgctccatgttggaaccagtcggattagtaagaacctggtcatacttttctcgtaaaactcgtacgcttaatgcggtggttaatgtttttccattggtccctgttacaataacaaggtcgtactttttgctaaaggcttggagaatatttggatcaagctttaaggttagttttcctggaagggaacttcctccgttcataaaagtatggaggaaccaatagcttgaccgcccggcaaattcggcaaatgaacttcgaactgtcatgaatatatgtattcctttcgtgtcaattgtaagtgatacaatagtgatgattaaaattaccgtttaattctaaactttacgataacaaaaagaaagttattaaactgaaattattataagattaaagttattcaatgtaaaaaactctttcctaatgtagaagtatttaaatgacacaaatttttggatataatgaagagtactatgcaaacaaaaaggggcaattgtagtggcacaactattctttaaatatggcgcgatgaattctggtaagtcaatcgatattttgaaggttgctcataactatgaagaacaagggaagccggttgtcttaatgacgagcggcgttgatgatcgttctggtcgaggcatcattgctagtcgaattggcttagagcgtaaggtaaaaccaattatggatgataccaatatttacgattacgttaataagatggaccgtaagatatattgtgtattgatcgacgaagcacagtttttaaagaaagagcatgtcttacaattaatcaaaattgttgatgagctaaatattccggtaatggcttttggactaaagaatgactttcggaatgaattatttgaaggttcaaaatatttactgatttatgctgacaaaattgaagagatgaaaacaatttgttggttctgtcctcacaaagctacgatgaatttacggattcataatggcaagccagtatatgagggagaacaagtccagatagggggaaatgaatcatattacccagtatgccggaagcactattttcatccccaattaaaacaataggaggaataaccaagaatggaaatggaagaaattttcgataagcttcaagcggttgctgatcgttacgatgaactaaatgaattgatcagtgatccagaagtaattgccgactcacaacgttttatgaagctttcaaaagaagaaggaagcttacgtgaaacggttgaaaaatataatcaatataaaaaagttacccaaacgattagtgatgatgaagaactattacgtgaaacgaatgatgatgacttaaccgccttaactaaagaagagttagcagaagcacgagaagaacaagcacagttagaaaaagagcttgaagtcttactaattccgaaagatcctaatgatgataaaaatattatcatggaaatccgtggagctgctggaggagacgaagcaagcctctttgctgctgacctttataacatgtaccttcgctatgctgaaaagcaaggctggaaagtagaagttgtggatcgaaatgaaactgaagtcggtggctttaaggaaattgccttaatgattactggggataaagtttattctaagcttaagtttgagaacggtgcgcatcgtgttcaacgagttcctgttactgaatctgctggacgtgtccatacgtcaactgcgacggttggggtaatgccagaagctgaagacgtagatgtggacattgatccaaaagatatccgggttgatgtttaccgttcaagcggtgccggtggtcagcacgttaacaagacttcatcagctgttcgaatgacccacttgccaacagggattgttgttgcaatgcaagatgaacgttcacaacagcaaaaccgggctaaggcaatgcggattttgaagtcacgggtttatgattattaccaacaacaagaacaaagcgcctatgatcaaaagcggaaagacgcgattgggacaggtgatcgttcagaacgaattcgtacttacaactacccacaaaaccgagtaacagatcaccgaattgggttaacattaaacaagcttgataagattatggctggtgacctcgatgaaattattgaagcattgattgttgccgaccaaacgcaaaagttggagcaattacggaatgagtagtttcgtaccgaccaactattttatggctcagcgatgggcaaaagaacaattacaaggaaaagatattgatccaagtgccccccagtttttacttcagcaatcacatggttgggatgcgactcacttacttttacataatcgtgatgagatgccggctgacgaagtagactggtggaaggatgccataacaagattgcttaatcatgagcctgctcaatatattgttgggcaggccccattttatggacgaacttttaaggttaataaaaatgttttgattccagaagctgagacagcagagttaatcgattgggtgttgcaagaaatgccatctcgtccattgaaggtccttgatttaggaacggggagtggagtgataggcattactcttgcacttgaacggccaaattggcatgtaagtttaagtgatatttcacccgctgcacttgctgttgctcaggaaaatatggctaagtttaacctggagttgccgttaattaaaagcgatttatttgaaaatattgatcagcaatacgatttaattgtgactaatccgccttatattgacccggacgatactggtgaaattgatcaagcagtccttgaaaacgaaccagccttagccctatttgctaatgaacgtgggttaggattctatcatcgcttatttaagcaagcagggcagtacctaactacgactggtcaaatatttggcgaaactggttatgatcaagaggagtcaattcaagaattactacatcaaaccgatgaacacgcacagatatgcccacgacatgatgtggcaggaaaaatgaggatgatacacgcatgggatttttcaaacgcaggaggaagatagtaagaatggatacgaagatttttcgacatggtgagattgcccaagcagcagctgcgattaagcgcggtgaattagtggcttttccaaccgaaactgtttatgggttaggggctgatgcaaccaatgaaaaagccgttaagaatgtttatttagcaaaagggcggccaagtgataatccattgattgttcatgttaactccatcgcaatggttgaaaagtatgctgccgagattcctgataatgcccgaaagttgatggatgcattttggcctggttctttaaccattatcttgaagattaagaagggcgcactttcaaaaaccgtcacaggtggtttgaaaactgtcgcctttcgttaccctgactgtcaaccaacccttgatttaattgaagaagctggtgttccgatggtgggaccatctgctaatacttctgggaaaccgagcccgactactgctcaacacgtttatcatgacttgcatggtaagatctctggaattgtggataatggtccgacacgggtaggagttgaatccactgtccttgatatgtcaacagaccaccctgtaattttacgtcctggtgctgttacgaagaaggacattgaaaaagtgattggatccattgaccttaatcatcataaagtaggcaaaaatgaaactcctaaagcacccggaatgaaatacaagcactatgcacctaaggcccaagtatatattgttgatgaagatactgattgggataaagttgttgaatggatacgacaacagccatttgacgttgggatgatggctgaagaaaaagtccttcaacaagaagtattgccgatgaacgctattcaattttcattaggaaagaatgttcaagatgccagtgctcgtctatttgatggcttacggcaatttgatgaccagcctaatgttaaagcgattgtcactcaagcatttccagctcatgatttagggggcgcatatatgaatcggttaaataagtctgctggtggtatgcactttgatagtaatgcggtaaaataataagggaatctagtggaagaggtaccactccctaattaaaatctcaataaaataataaagagactgaggcggattcccagcctctttatttataaccagaggagatgttgtaaatgaactatggtaaaaaatcaccccaattatgggcagccattgaaaatgaagaacaacgccagcaagatacgattgagctcattgcttccgagaatattgtttcagatgctgttcgtgaagcgcagggatcagttctaacaaataagtatgctgaaggatatcctaataagcggtattacggtggttgtgagtttatcgatcaagttgaacaattggcaattgattatgctaaaaagttattcaatgcagcatatgttaatgttcaacctcattccggatcacaagctaatatggcagtttatcaagcactcctcaagcccggagatgtgattttagggatggggatggatgctggtgggcacctaactcacggagcaacggttaattttagcggaaaactatataagacgtatggctatggcttaaatccagatactgaagagcttgattatgatgaaattatggctttagctaagaaagtaaaaccacaattgatcgttgcgggagcgtctgcctatagtcggattattgattggcaggcatttcgcaagattgctgatgaagttggggcttacttgatggttgatatggctcatatcgccggattagtagcaactggtacccatccaagtccgcttccaattgctgatgtcgttactactactactcataaaactcttcggggcccgcggggaggaatgatcctctctaaatcgactgagttaggacggaaaattaattcagcggttttccctggaatccagggtggaccgttggaacatgtgattgcgggtaaagcacaagcattttatgaagatttgcaaccagaatatgcggaatatatccaacaagttgtaaaaaatgctcaagcaatggaaaaagtatttaatactagtaaacagattcgggtggtttcaggaaaaactgaaaatcaccttctcgttctggaccttacgaagactggtttaacaggaaaagatgcgcaaaatctccttgaccgtgttcacattacaaccaataaagaggctattccgaatgacccacgaagtccatttattacaagtggtttacgaattgggactcctgctattactagtcgcggatttaaggaggaggatgcgcaaaaagttgcggaattaatcagtacagctttaactaatcccaccgatgaagagcggttacaagaggtcgcaaaaggggtacacgaactaaccacaaagtatccgcttaactaaaaaattagaacataaaaagttgttaagatcctttgtcatgacttgatttttttggtagaatagtgaagaaattcaaaggagtgtatagaggcatgggtaaatttgaagtgttagatcatccattgattcagcacaagctaacaatgattcgggataaaaatgttgggacaaagtttttccgggaaacggtcaaagaaatttcaactttaatggcttatgaagttgcacgcgacatgccattaaaggatgttgaaattgaaacgccaattgctaaaacgacccagaaagaattggctggtaaaaaggtagcgattattccaattcttcgggccggaatcggaatggtggatgggatgacggaccttatcccagcagctaaaattggttttatcggaatgtaccgggatgaagaaaccttaaagccacatgaatactttgttaagttacctaatgatattacagaacggcaattattcatcgtcgacccaatgctggcaactggtggttcagcaatgatggcaatcgaagccttaaagaagcgtggttgctcagaaaagaacatgaaatttgcttgcttagttgcagcccctgaaggagttaaggctgtgcgcgacgcttatccagatgttgatatttatacagcaggacttgatgatcatcttaatgaagatggatatattgttcctgggttaggcgatgctggtgaccgtctttttggtactaagtagattattaaggattaaaagcatgatctgtagaaaactttttagctttcgcaaatcttgcttttattttttatttgtgttgaaaaggctttcgcttataataggtactataccagaaaaggggaattgattaatggagacccaaattaatggaattgcagccagtgatggagtgggaattgcacctgcttacttattgacgaagcctaatcttagttttgaaaagtatcatattagtgaccccgatagtgaaaaagcgagattacaccgtgcttttgagaagatcattcagaaactaaaggaaaccaaaaagaagcttgttgataaacttaatgcagaagatttgacaatttttgatactcatattgcaatcctaaacgatccggaaatgattaaacaagttgaaaaccggatcacaaatcaacgcttaaatgcagaatcggcttttgcagaagtaattactaagatgatcaaaacccttcaggcgatgactgggaatgaatatatgcaagagcgggcatctgattttcaaaatattcaagaccaggttttagcagagttagaagagaagaagctccctaatttgcgcgaattagatcaccctgtcattgtagttgcccattcgattggtccggccgatacttcacagatggatggccgctttgttaagggaattattactgatttgggtgggcggactagtcacgcagcgattatggctcgttctttacagattccagcaattgttgggtgtaacgacataaccaaaaaggtgcaaaatggccaacgagtaattgttgacggctttgaaggcagtgcaattgttgaaccatcaacaaatgatgttaaacaataccaaaaaattgctgataagtttatgaatgtccgtcagcaatggaaaaaaatgattaaccagccctcagcaaccgccgatggtcaacggtacaagatttcagctaatattggttcttcagtggatatttcgtcagcaatagaaaatggtgctgatggtgttggcctatttcgaactgaatttctttatatgaaaagtgaccacctcccaaccgaagaagagcagtttaatgcttatcgccgagctgttgaacagttaaatgggaaacggttagtggttcggaccttagatatcggtggcgataaaccacttcaatttatgcccttacccaaagaaatgaatccattccttgggtaccgggctattcggattgctcttgatcaaccagaaatgtttaggactcagctgcgggccttactccgcgcatccgagtttgggaagattaatattatgtttccaatgattaccacgcttgaagaattacgagcagctaagaaaatctattatgaggagcagcagaaattagctgtcgatcatcctgggattggccgtgatgtccatcttgggataatgattgaagtgccattagccgcgttaaatgctgatcgcttagctgcagaagttgatttctttagcattggaactaatgatttaatccaatattgttttgcggctgatcgtggtaatgattcagtttcgtacctttaccagccgctgaatccaacttttttaaaattaattaagcacattatcgatgctgggcatgctcatgatacaactgtggcgatgtgtggagaaatggcaggagatcgctatgccttgccactattaatcgggatgggattggatgtctattcgatgagtgccagttctattttacggacacgttcaatgatgaaacaattagacagcaaaaaatgtcagaaactctaccaacaggctgttacaacttgtgattcaatgaccggtgtgaaaaagttagttcaagattggttggtagcaaactaaaaaggatttaggaaaagtaaagatttttcttaaatcctttttttgttgcttgttaagagtaaaatggcaatagttttgctgtactaaggggatgtaaagttgtgattaagcaatactggacaaagcaaagaatctggttgttaatttttttagtggttgttggaattggtgctctcttatttaccagccataatgaacagttttatcaacaaccaattgctaaagtaatcagcgaaaaaacggtgaataggcaaagggtaaaagaccagtttgataatgttgaccatcaatataatcaacaactccaagtaaaactaatgaatggtaaatatcgtgggcaagaattaacagtccaaaatacatatagcgattcgcaaccgatggatcaacgttatcgggcagggaatgaagtgtttttaacccagcttcgtaaacgaggcggaaaactaaccgccaatgttaacggttataagcgggacacagtaatcgtctttttactttggcttgttgtcttgatgctgcttctccttatgggacgttcagggctgtttgcattcttaagcgtagtaattaatgctcttttgtttataattgcaattgagattgacttaaagcaaaatggtcagcatatcatgctgctttttagtgttcttgccataatttttacgtttattagtttattattagttcttggttttagtaaaaggatgctggcgacttttgcggcaacagttattggaacatttgttgccttgggagtaagtatgcttgtatttatgtggacgcatgaacgggggatttactatgaatcaatggaatatgttacgcaagttcctcgaccgctttttttagctgaaacattgttggggtctttaggagcagtaatggatgaatcaagcgatattatcgccactctttttgagttaaaacagctaaatcccgctgttacccgcaaacagttatttatctctgggcgtaatgttggtaaatcaattatgggaccgttaataaatgttttgtttttaatttttatggtggatacctttaccggtagtcttttgtatatcaaaaacggcaactcatggggatatacttatgcaatgaatatgagcttagggactattcagagcctgatcagtgggattggaattgtcctttcagttccccttgtcagtctatttggggcattattattagggaagaaggtgcaaagatgacgacaattacgggccttggcttagtattgttaattttgatggtccttgtgggaggaaaacagggctggacagcttttttaagcttgcttcttaattttggctttttatattttgcaattattttagtcgcgtttcatgtccctccgttatttgtaacggtgactattgggattacaattttggcaataaccattttcatgggagaggatgatttgcggacaaccgtgacagccttttatgcttccctcagcgtgttatgtttaattttagtgctgatctttattgtcgagcactgggcaatggtgcagggctttggaacagaagatagcgatgagttagaaggaatgtcaattttaattggaattagttatttcaaagtttctgttactacgactattttgagttcgctcggcgcaattgcagaagcggcaatggcgatttcctctggccttacggaaatccttgagaatcatcccgaaagaactaatcgtcaattaattcatagtgggatggcaatcgggcaacagattattggaacaacatttaatacgcttttctttggcttcttcggtggattcttagcactatttatttggttcttaggtctccactattcctttggtacaattatgaataataaaatttttgtggcagaaatgattgaaattctgatctctttcattggggtgctgatcactgttcccatgaccgcttgggtgatgacaaagcggcgtaaatcagttattgacaatcatcctaaaacaaagtaatatacgaataacttataaatagacctttaatcggagtcctgtgaggcttcaaaggtgcggataaattctcaatactctttccatagttaggattgggcagaggaagagacgactttggagcagggattccaaggtcgttttttctttaggaggatttatatggcgcaccgtgataatgttgtattagatgtagacgaacggccggcaccttggcagtggtttggcttatctttacaacatatgttttctatgtttggttccactgttttagtcccaatcttggttggattaaatccaggaattgccttgtttagttcgggggtaggaaccctgatgtacttacttattactaagcataagattcctgcttatatgggatctagtttctcatttgttgtcccaatgatggctttaatgaaaactactggttatccaggaattgtacagggtacaattgccgttgggtgcgtatatttaatcatgtcagtaattgtaacgttggttggctcgcaatggattgaccgcattctgccaccaattgttgtcggtccgattgttgttgtaatcggattgtcattagcaggaacagccgctaaagatgctactatcaattcggctactggccattatgatttgcgcttttttgcggtcgcaatgcttacgatggcaataacagttatcttcaatatgtattttaaaggattccttggtttaattccgattttgatggggattgttgctggttatattattgcgatcttatttggtattgtgaatttttccccagttgcgcatgcacactggtttagtttgccagacttccagattccgtttgttgattatcatcctcaattatactggggtgcgattttgagtatggcaccgatcgctttcgttaccatgacagaacatttggggcatattatggttctgaatgagttgactgaacgaaattacttcaaggaaccagggttgaaccatacgcttgcaggagatgggacggcttcaattattgctggtttcgttggtggaccacccgtaactagttatggtgaaaatattggggtaatggcaattacgcgtgtccattcagtttacgttattgctggagcagctgtatttgccatcttctttagctttattggtaaattaagcgctctgattgaatctattccttcaccagttatcggcgggatttcattcctattatttggtgtgattgcctctagtggattgcgcgtaatgattgagaacaaaattgattttaatgaaaaaagaaatttaatgatttcatccgttattttagtaattgggattgggaatgcctatcttcaattgggaaaatatcaattctctggattagcagttgcagctgtcctcggaataataatgaatttaattcttccacaaaaagccaaaagtgaaatgtagtttggatttttaagcagagtgagaaaaaggcatctgacctcttactttgcttttttcgtatgataataaaacaaaaaaattgagcggtcgtggaaaaaacagattgtgagaaaaaagtttatcaaacctataaaagcgttttctttgcactcttatcaatcgattagtaggtatatataaacctaatgtttttttgaattttaacgaaattaatgatatattaacattcgtaacttggggtagttcgttttatttgcaacgttcatccaatttacaagccaaattattgttataaggaaagaggtggaatatgaatgggcggtgatgctttaacttttaagcttttcggactcacgttcaatactacgaacattgtttctggactgattatctacgcaatcgtgttcttcactctttacgggatgtcacgaaagatccaaatgaagcctactggtgcacaaaatgtatttgagtggctagttgactttactaatggaattgtgcgaagtcagatgccagcatccgaacaagggcactatagtttctttgcctttgttttgtttgttttcattttctttgcaaaccaattcggtttaattttccaattccattggaacggagctgaagtgcttagaagtccaacggcagatccagttgttacgttaacactttctttaatggtaatggtattagcattcgctgctggagtagcacataatggccttggtggatacttgaaaggatacactaaaccatttactttaatgcttcctgttaacattatcgaagactttgctaacttcttaactcttggtctccgtatttttggtaacatttttgccggtgaacttttaatgagtttgattgctaatatggcattctcacatggaatcctaactattattccaggactatttttggaactagcatggcaagggttctccgtatttatcggttcgattcaggcatatgtctttgtaacattaacgacggtttatatttctcggaagatttccgaataataatccctaaggaggaattttaaaatggcattaggagcaattgctgcaggactcgcggctatgggtgccgctatcggtggtggtatcggtgacggtatcttaatcggacacacagttgacagtatcgcacgtcaaccagaattacaaagtagattacaagcaacgatgtttattggtgttggtttgattgaagccatgcctattattgccatcgttattggcttccttgttatgaacaagtaattattttaagttttttatttttttaagataaggaggtgtcaatagatgtttgtaaacagtgtgttagctgaatcaaacagtttatacattggtgacttggtattctacatcgttacttttatcatcttaatgctattagttaagcattttgcttggaaaccagtaacagatatgatgaagaaacgtgcagataagattgctaatgacattgataatgctgctcgttcacgtgaaagtgctgaaaagatggctgcaaagcgacaagcggagttacaaagctcacggcaagaagctgctgagattgtaagtaatgctaaaaagtctggggaaactcagcgagcacagattgttgaaacggcgcaaaaagatgcccaagctctcaagcaacaggcacaaaaagatgctgagcaagcacgtcgcgatgcattaaatagtgctaaggatgacgttgcaaacttatctattgagattgcttccaaactcatccaaaaagaattaaaggcagacgatcaaaaagaattgatcgattcctatatcgaagggttggtagaacatgagtcttgataagaagacagttgctgatcgctatgcgaaagcactgtttgaattggtcgatgctgataacgaactcgatcaaacttatcaagaattgattgctttacgccaagtctttgaggacaacgagggattggacgccgcacttgcgggagttcaattgtcacttgatgaaaagaaatcattgattaaagatttacagcaaggtgcttcgaagtatgttgctaacttaattcaaatggttttcgattacggccgtattgactgcatggtcgcaattattgatgagtttgaacggcggtatgaccgtaaaatgaagcggatgcatgctgacgttaccacagcgatccaactcgataaacaacaagaggatcaactgaaggctaatcttgcaaaacgttttggtgctaatgaagttaccttaacgaaacatgttgatccagaaattttaggtggggttattgtccatgttgataataagacattagatggtagtctcagctcaaagattaagcaaattcgtcgtttactagttagataaatatatcttttttcaaagaggtgagacctttatgagcattaaaactgaggaaatcagttcactcatcaaaaaacaactcgccaactaccaagacaaagtatctgtcgaagaaaccggtactgttacctatgttggtgatggggttgctcgtgccgatggcttagataatgctatggctggtgagttgctcgaatttagtaacggggtctacggaatggctcaaaacctcgaaagtaatgatgtaggtattgttattttaggggattacacaggcattcgtgaaggagacaccgttaagcggacgggtcgaatcatggaagtacccgttggcgatgcattattaggacgggttgttgactcattaggtcgtccaattgacggtcttggtgagattaagacagataaaactcgtccaattgaacgtaaagctccaggtgttatggagcgtaagagtgttagtgtgccacttcaaacaggtattaaggttattgatgccttagttccaattggacgtggtcagcgtgaattgattatcggtgaccgtaagacaggtaaaactgccattgcgttagacaccattattaaccaaaagaaccaagacgtaatttgtatttacgttgctattggtcaaaaagaatcaactgttcgggctagtgttgaaactcttcgtaagtatggagcattagattacacaattgttgtttcagctagtgcttcaaatcctgctccaatgttatacattgcgccatatgcaggggctgcgatgggtgaagaatttatgttcaacggtaaagatgttcttattgtttatgatgatttatcaaaacaagcggatgcataccgtgaactttcattaattcttcgtcgtcctcctggtcgtgaagcttaccctggtgatattttctatactcactcacggttgctagaacgtgctgctcgtttgtctgatgacctcggtggtggttcaatgaccgccttaccaatcattcagacgcaagctggtgatgtttctgcatatattcctactaacgttatttctattactgatggtcagatcttcttagattcagatgaattctatgcaggtcaacgtccagctatcgatgctggtacttcagtttctcgtgttggtggtgacgctcagatcaaagcaatgaagaaggttgctggtactttgcgtttggatattgcttcatacaacgaattagcatcctttgctcaattcggttccgaccttgatgcagctacgcaagctaagttggctcgtggtcaacggactatggaagtcttaaagcagggattacatgatccgctaccagtagaagaacaagttgtaacattatttgctctttcacgtggctttatcgataaagtcgaaattgaagatgttcaacgttacgaaagtgaattggctgcttacatgcatgctaaccaccaagacctctacgacaccatcaagaagactggtaagctaccagaaggcgatgacttgcaaaatgctgttgctaagttctctgaaacatttcaagggacaaaaaagcaagtcgctgaagaaaaatagttaatgatgattagtcgaaaggacggtgagatttagtgccagcttcactcgctgcagttaaacataagattgattccactaagagtacgcgtcagattacttcggcgatgcaaatggtttcaaccgcaaaactgaatcaaattcaacaccacactcagacctacgaagtatatgctgagaaggttaagcaaatgttgtctgatctggttaaatctcacagcgcaacatctgcagcttcgcaagatgatgtttacgctgcactgtttaaaaagcgcgcagttaaaaagactggggtgcttgtgattacgtctgaccgaggtttggttggtagttacaatagtaatattatcaagcaaacgttagatatgatggctaagcacaatcttgataaagacaacacagtattcttgacggtcggtaaaactggaacagaattctttaagaagaggggaatgaatgtcgtttacgaatattcaggcgttagcgatgttcctacctatcgggaagttcacagtattgtgaagactgctgttcaaatgtacagtgatcaagtatttgatgaaatgtacatggtttacagccattacgttaaccgaattacatcaaatgttattgttcatgatgtacttccaattactgaaaagtcattactcgatgacgaaaatgaagcgcaagaaaatacagaattaaataattctgatgtaagtactgcgcatgtttcagccgagtatgaatttgaaccgtcagatacagaaatcatttctgcattggttgcccaatatgcagaaagtttgatttatggagcgattcttgatgccaagacatcagaacactcttcaagtgcgaatgcaatgcgttcagctacagataatgctgatgacattatctctactctcgaattgcaatataaccgagcacggcaagcagcaatcaccactgaaattacagaaattactggtggtatgactgctcaagaataattttttctaacgtaggaggaaacaacatgagttctggtaaagttttacaagttatcggaccagttgttgatgttgaatttcccttagacgaaaaacttcctgaaattaatgacgctttgaagattaaggaaagcgatggtaagactttaacaactgaagttgccttggaattaggtgatggtgttgttcgaacaattgccatggatggtactgatggtcttcaacgtggtatggaagttgaaaacactggtgcatcaattagtgtaccagttggtgatgatactctgggacgagtatttaacgtcttaggggaacctgttgacaacggaccgaaatttggtcctgatgcaaagcggatgcctattcaccgtgatgcaccaaagtatgatgacttaaataatgctaccgaaattttggaaactgggatcaaggttattgatttactagctccatatgttcgtggtggtaagattggtctattcggtggtgccggtgttggtaaaaccgttttgattcaggaattgattcataacattgctcaaggtcataatggtatttctgtcttcacaggtgttggtgaacgtacccgtgaaggtaatgatatgtactatgaaatgaaggcctctggagttcttgaaaagacggccatggtttatggtcagatgaacgaaccacctggtgcccgtatgcgggttgccttaactggtttaacaattgcggaatacttccgtgatgtaaagggacaagatgttttgctctttatcgataacatcttccggtttacacaagctggttcagaagtttctgccctcttgggtcggattccttctgccgttggttaccagccaacattagctactgaaatgggtcagttacaggaacggattacttcaactaagaagggatcaattacgtctatccaagccgtttatgttccagctgatgactataccgaccctgcaccagctacaacatttgcccacttggatgcaactactaacttggaacgtcgattaacccaaattggtatttatccagccgttgacccactagcttcaacttctactgctcttaccccagaaattgttggtaaagaacactatgaagttgctacacaggttcaacacgttcttcaacgataccatgaacttcaagatatcatctctattttaggtatggatgaattatctgacgaagaaaagacaatcgttgctcgtgcacggcggattcaaaacttcctttcccaaagctttagtgttgcttcccaatttacaggtttacctggtaaatatgttccattaaaggaaacaattaaaggctttaaggaaattcttgctggtaagtatgatgatcttccagaagaagctttccggttagttggaccaattgaagacgttgttgaaaaggcaaagaaaatgaaggctgagactgacgaagatagctcagaagactaggagggataattatggctgaaaatacttttaaggtcactattattactccagatggcaccgtctatgataatgataaggttaccatgctcgttatgaacactgctggtggacaaatgggaatcatggctaaccacgtaccattaattgctgcacttgaaatcagtacagttcgaattaaacattctgaaggcactgatgaagttgcagcggttaacggtgggattattcaatttgatggtcaaaatgctacaatcgcagctgatagtgctgaaatgcctgaagcaattgacgttgagcgggcacagagagctaaaaagcgttctgagtctgcaatcgcagaagcaaagaagaagcataaccaaagcgacttatcacgtgcagaagttcacctcaagcgtgcaattaaccgtttgaatgctgcttctaagcaacgcaatatctaaggtataatattacaaagaggctggagaaaataatccaacctctttactattttaaagtgtaaattgccaaaccacagtagatgcttagccatccttgcgggggtgggactaaaacttacaagcgagtttagtctcacccctttttcgtttaaaagatcattaagcttttttacgaattaataatttaatcatgtgatatgatatgattgaatttagtttaaaagagggtgatcgattgcaaattacaggattacgagcgctaatagaaataatagtgcaattggcatttgtctggttagcgttttttgctattcaaggaatacattttgagcatttttttaaccgaccaccgcgcacattacctttactcattgttttaatggctactggactgggatatttatgtgcgacatttttcttaaatatcctaagtgcaattgggaatttaacatatttaattcgatagtatttactggaggaacttatggaaaaaattgttgttaggggcggtcagaggttaaccggtcgagttaaagttgaaggagcaaaaaatgcagtcttaccaattcaagcagcatctattttagcttctagcggaaacattaaattatcaaatgttccaattttatcggatgtaacgacaatgaatcagttattacggttcttaaatataaaagtagattttgataaggataagcacgttttgacaattgatgcggctgatcctgtatcatctgaagcaccattagaatatgttagccggatgcgggcatcgatggtagtcttaggacccttgctagctcggacagggcatgcgcaaattgcgcttcctggtggatgtgcgattggatcccggccaattgacttacatcttaaaggattacgtcaattaggagcaattattgagcaacacgatggatacttagaggcacgggctgaacacttaattggtgatcacatttatttagatttccctagtgtcggtgcaacgcaaaatctgatgatggcagcaacacttgcgcaaggaattacaacaattgaaaatgctgctagtgagcctgaaattgttgatttagcaaacctgttgaataaaatgggtgcacgtgtccatggcgctggaacagacattatccggattcaaggggttaatttccttcatggttgtgaacatacagtaatgccggacaggattgaagcggggacattcatgattgcgacagccattactaatggtgacgtcgtggttgaaggggcaattgctgagcataacacctcattgattgctaagttggaggaaatgggtgtgacagtcatcgttcaagaagatgggattcgtgttctggggacttcggttttaattcctacgaatattaagactctcccatatccaggtttccctactgatcttcaaccacaaatgtccattctccagcttttggcaaatgggaccagtaccctagatgagacgatttttgagaagcgttttatgcatttagaagaattacgacgaatgaacgctgattttcaaattaatggtccagttgcggttttaaatggtcctacgcattttagtggcgctgaagtagctgcctctgatttacgagcgggggctgctttagtattggccgggttagttgctgatggaattacccaggttcgtaacctaaaatatattgatcggggatattaccatcttcaccaaaagttacaacaattaggggctaagattgatcgaattgatgtcgaggataaaattaaattggcggtaaagccttctaagaataaaacaaatcaagattaaagattcgtaagcgacgtctatctgtatctctattttgtggtataattacgaacgatattaacgagtttagcgttaagacttaactagctaaaaggagaagaaattaatggcaaaggatattggaattgatttgggaactgccaatgttttgatttatgttcaaggcaagggtattgttctaaatgaaccgtcagttgtggcggttgatacaaaaaccaataaagtattggctgttggttcagaagcataccgaatggttggacgtactcctagtaacattcgggctattcgtccattaaaggatggagttatttctgattttgatgttactcaagaaatgctttcctactttattggtaaactaagcgttaaagggttcatgtcaaagccaaacatcatgatctgtgcaccaacgaatattactgagattgaacggaaggcaattattcaagccgctgaacaatctggtggtggcaaagtttaccttgaatacgagccaaaagtagcagcaattggtgctggattagatatttttaaacctcgtggaaacatggtcattgatatgggtggtggtaccagtgatatcgctattctttcattaggcgatattgtctcaagccagtcaattcggatggccggtgataagatgaatagtgatattgcttcttatattaagaataagcacggcctagtaattggtgaacatactgctgaaaagatcaaaatggaactcgggactgcattacgggttgatgatcctgaaacgatggatgttcgtggtcgagatgtagctactggaatgccaaagcaaatcactgttaatgaaaatgaaattgaagaagcattgcatgatacgcttgaacaaattgtttcagcagctgtaaatgtattagaaacaattccaccagagttagctagtgatattattgaccggggaataatgttaaccggtggtacttctttattaaagggtgtcgatcaattattcagtgctcgtctaaaagtaccagttgttgtttcgcaagacccattagacaatgttgctaagggtgctggtgaaatgttagaacggatgcaaaagactgaacgaaagaagtagttgaaatggtaaggattttatgtgaccttatacgctggtatcaacaaggcatttctgcccaacgaccatttcgcgtatgtcgctttaccccctcatgctcgcagtatatgttagaagctttacaacgttttggcttaaaggggatattgctcggaagttggcggctccttcgttgtcagccgttttctcgtggtggctatgatccggtacctaatcattttacttttcgtcgtcaggggtaataatagttattaagggtgaaaaagtgtcaaagaaagataaaaaagtagaagtcagcgttaaagatattgaacgtcataatcaaccggttcaacaaatttttattggagaccgattgattggtgaagttgtaaccgataatgaacgtttcaaagcaatgctgataagtaaccagagcgaattttatgttcgttctcaagaagagggattagaaatagtccttcaacaatatcatcttcaccagcattagtttggtgaaccatcctctttgattaataatttgtaaaggagtttggtaatgcaacgttcgcaaaatgatgtagaaagtcggattgactggggaattatattctgtgttcttttgctagccttgattggtcttgcctcaatatatgtagcggcagttcatgatcgacagcaaactagtgtagcacgacaggttattacccagttggtttggtatgcggttggaacaatccttattattgtcattatgcaatttgatgctgaacaattatggaaattagcaccaattgtatactggctaagtgtatttttaatgttcgcaatcctagtcttttatagtcgagcctattatgctagtacaggggctaagagttggtttgcaattgggccatttacgtttcagccttcggaaataatgaagcctgcctatattttaatgatggggcgtgttattacgactcataataatcgatatagtgtgcatactgttgattcagattggcgattaattgggacgatgttcttatggctattaccaattttggtttcgctgaagtttcaaaatgactttgggactgggttagtattcttcgctattttctgtggaatggtcttagtttctggagttacttggcgaattttggcgccagcagctacgatattagttgttgttgggggctcagccttagcgatggtaactagttcggttgggcgacaaatacttgaacatgttggatttcaagcataccagtttgatcgggttgacacctggcttcatccagaacaggatacaactaaccaagggtatcagttatggcagagtattaaggcggttggttctggtggtattactggaactggttttaataactcaaaggtttatgttccggttcgtgaatcagatatgattttttccgttatcggtgagaattttgggttcattggtggggttttattaatccttatctatttgttactgatctacttaatgattcgagtaacattcgataccaagaacgaattctatgcttatatctcaaccggagttatcatgatgattttattccacgtttttgaaaatattggaatgaacatcggtctattaccattaacaggtattccgcttccatttattagtgctgggggatcctcattaattggtaacctgattgggattggaatggtgatgtcgatgcgttaccaccatcattcgtatatgtttagcagtaatcgtgaatttagatagtggggtcataaaatggcaaaagattatttttgggtaaaagaacaagcagatggtactaaacgtgtcggcttaaacgatgaaggccgtgatgagttaggagaagtaagtttcatcgatgtaccggcagtagggacaaccttgaaacaagctgataagtttattgcggttgaagcagaaaaagcagttaccgatgtggatagccccattgatggtaagattaccaaattaaatgaagctattattgatgatccggctggattaaattcaagcgatatggaaaaaaactggattgttgaagttaaataaaaattaggggactaggattaaggccacttgattctagtctcctattgttagtgtaagattttcataggttggatgaataattcatctggtcgtggaaatcttttttgtagaccaatttacttatttacaaaaaaagaaaagaccagtagcctttagtgtgtcgaatactaagcaaaggcaggtctttcctcatggatattttaacagaaatcgagcagaatttggtgaaatcaggcagtttatttgaagctgaacagattattttaaaaggggtattggagttaggacaagtaatcatgcaaaactttttggaaagcttagatcgaagcttaaagtcccaagctccagcgaactatcaagtaatcaataaacagccacggacgcttaattttatctttggcccggtgacttttcaacgacggtattatcaggctgggacaaagaaacgtgaattttacttagaccaacaattaaaaattaaaccacgtcgtcgtttatcgccacactacttaatgatgatggctaagattgtccaaacaactacaatgcgcaatactgccgacattttgaaccttgtatttgacagcggaattactgccgattcggtaatgcacgccgtgcatgagttaggaaatcaggtagctaaacaaactcaagcaaaagaacaccaagctacccctcgccatatgcctaaaaatttaactattgagggtgatgcctttatgattaaaggtaaaaaagaagcaggtcagctgactcattatcgggtttatgagcgagtagctaatcaaatcattaatcggcatgactttctcagtgttgggcaccaaggacggcttgaagcacgactaagtgattatttagaccgccattataagcttgccggtcaaacgatctttttggccagtgacgctggcccaggttacgaaccagctaagctattaagtctagttcctcaaggtgcacatggtgaatactttctcgaccgctatcattgtttacagaaaattgaacatactttaggccggcacaacgaattagccatgcgagcaattaaagccgttcgtcatcatgatcaagcagagctaacaataattttagatacttatgaatcacaaaacctaacggaaaaacaagcagacgacctaatgcgtttaagaaagtatctacagcgaaattggcggtatatcctctcaccacaaatgcgtggatttaaggatattcatttaattggttcagtcgaaagttctcaccgggcttttacttaccggatgaagaaacagggcaagtcatggactaagcagggggctaaagccatgattggtttaattgaagcccgaatgaatggtgaactgcaagctagtttaaatacaatcctagaacaattaacagttcttcctcgagtggctcaaaccagcctattacaggaaatgcatattcgaactggagagtttctaagaaaggcaccgacaaagccgtcaattggagtagtacaaggaataattccgattaatacggccacaagtagaccaataggacaactttttaaggcactaacccactaaaactgtatatttaaaggctacctatgaaaacttgacagatactctcctattttagtattggcggatctttccagttcatgttatacttaaggttctaggaaaacggctaagataaaaatatttaaggtggtatttattatgacccaaaaattacacatcgctttattatttggtggcaactcctctgaacatgatgtgtcaaagcgatcagcacataatatctatgatgctcttgataaggaaaagtatgatgtaagtctttttatgtttacaaaggatggaattctattaggcaatgaggattcccaaaagatctttgatggcgaacctgaagaccaagtggtagcggaagcatatcaaaagatggatatgagtagtccattagcaccaattatggccttaaacgaacaaaaggaaattgatttcttcttccctgttatccatggtaatttaggtgaagatggtacaattcaaggtctctttaagctccttaataagccatacgttggttcaaatattgcagctagtgcgatgtcttttgacaaggaccttactaagaagattattagtcaagctggtattcgcaacaccccttatgtagtagttacgccagaaaaccaggctgactattcatggggacggattgaagaaaaattaggcaatctcacttttgtaaagccagctaagcaaggttcctccgttggaattcatcgagttactaacgctgaagaatacgaaaaagcattagacgatgcctttaagtatgactacaagatcttagtagaacaaggaatcgctaatcctcaagaaattgagatttcaatcttaggaaatgaacacccaattgcctctaagttaggagctgtacgtgtacctaaggatgatccattctatgattatgaaaacaaatttgtggatgccagtggagttgtttttgaacttcctgttaaattaccacaatacttagttgatgaaattacagacatggctttgaaggcatacaaggcattaggaatgaaggggatggctcggattgactttttagttgacagcaataatgtcccttatcttggtgaaccaaatactttaccaggatttactaacattagtttgtatcctcaaatgtgggaagtttctgggatttcatattccgacttgattgatcggctaattcaattaggattacaagaatttgaacgaaacagtaagattaagtacgatttccgtaagcttggtaccgaacgtgttggtcaaaagaaatataacgaagactaaagaataattatttgatggttaggatgttgtgagtacaatgtgctaactatttttattattaaactcataatagaaagtaaatgttatcgtaatggtataaaatctgtggtttagtattgcagtaagaacaatttataatataatgaagatacgcagtttttgtaagtattagactggcctacagtcacgctacttgcagtactttataaccatcgcgggggtgactgtgaagatggttataagcatttattttttataaaatttattgcattttaagcataaaaatagtattgatttatttttggtctataataaaagacctaagtaaaaccaaagtaatttttgttgctaatggtgtataatacgattggcaatggtacagttcatagagtacataatttatattcaacaattatgattaaggaaggtaaacaatgagactccgaggagacgtattaaaacaaattcgtcgcaagcgtggattgtcccaaacggctttagctgaagggatttgtactcaagcgacaatcagcctaatggaaaaacaaaatcgattacccaaaatggatattttaacggcaatatgtgaacgcttaaatatttcttctgatcgaattgtcgaaaatgaagttagtggaattaatgaaacattcaaccaaatcgttgataatttgatttcacgcaattttgaagatgcttcagcgcttttgaagaaggttcatgtaaaaaatctagaaagtgattttgataaacaacgttactactatctagtaggaatggttcaagttgaaaataatcaaattgatgaagccatttttaattttgaacttgttttaactcaatttgctactactagtgctaatatttatttagccatgacaactgcaggaatggcacttgcttacttaaaacgtggtgataaagaacgggcagcacggttaactaaccggtctgtaaaactgattgacaataaaaaattgattgggagccttcatcaatgggcatcaattgattgtcaaattgcagcattatatcttcaacttgaagaccctgataacgctattgaagttgctaataagggaattgaactttgtcgggaacatgattcattattcttattagatgaattatatctttgtataggtcgtagctacatcctaaagaacgacaaagaagaagctaaaaaagcattaaagattgctgaaagtcttagcattgctcgtaatggatcagtagcagaagatacaattctattagagttaaagaatttagaaatttaattgatatgcgtaactgaaaaacgaagctgagagatggttgatatgtctcagcttcgttttttagtataaatttaaatatttatccgtacaaataattaataaaaacttaattgattattaaagactaattccagtttatgtgcattaaacgagaattagtcttttttggtagtaaaaaaataaaaatatttttcacatgcataactgcttctaaatacaagatagacatgaaattgttaaatgtataaaatgctttttcacaattggttatgattatttttaaataattcgcttgatttatccgtacaaatattttatagtaataattgttcaatgaaagcgcgttcatgttcatgaaaaactactactttttaatttttaaggaggatgaatgtaatggctaaagccgagaagaaaatatcaagtgcatttatctacttcttcggatcatttgggggcatcctatttggttacgatatcggtgttatgactggtgccttacctttcttacaagctgattggcaccttgaaaatgcagcttctctcgttggttggattacttcagcagttatgtttggggcaatcttcgggggcgcattagccggacagctttctgataagtttggtcggcggaaaatgattttaatgtctgcgattgtattcatggtattctccgttttatctggtgtttcaccagacatgggcgaagcaagtgcctattatctgattattgttcggatgcttttaggtttagcggttggggctgcctcagccttggtaccagcttatatgtccgaaatggcaccagctaaagcgcgtggacgtttatctggacttaaccaaacaatgattgtttccggaatgttattgtcatatgttgttgacttcctattgaaagaccttcctggtgaatgggcatggcgtcttatgttaggattggcagctgttcctgctttaatcttattccttggtgttcttcgtttgccagaatctccacggttcttattgcgtaaaggtgatgaagcacaagcacggaaagttctttcttacattcgtaaaaatccagctgagattgaccaagaattagcaagtattaaagaaactgctaaagaagagcgacaagcaaatcaaaagacaagttggtcaaccttattcagtggcaagtatcgttacctagttattgctggggttggggttgcagccttccaacaattccaaggtgcaaacgcgatcttctactacattccattaattgttcaaaaagcaactggccaagctgcatcttcaaacttaatgtggccaattgttcaaggggttattttagttgttggttccctggtttacatgtggattgctgataaatttaaccggcggacattgttgatggttggtggtgctgtcatgggactttctttcattcttccagccgttattaattggatgatgccaaatatgaatccgatgacaattgttgtgttcttatgtatctatgttgctttctactccttcacatgggctccgttaacatgggtgcttgttggtgaaatcttcccactagctatccggggtcgtgcctctggtttagcttcatcatttaactggattggatcatggttagttggtcttatcttcccaattatgacggcaagtatgccacaagaagctgtttttgcgatcttcggaattatctgtatcttaggagttctctttgttaagacttgtgttccagaaactcgtgggcacactcttgaagaaattgaagagcaaggaacaaaccatggtcgagtaaaggccagcaatcctgaaaactaggaggaatactctatgaatttacgtgaaacagcgacacaagtaaaaaatggtcaggcttcactaggaattgagttaggctctacccgaattaaagcagtcttgattaatccagattttgaaactatttcttctgggagttatacctgggaaaatcaattgaaagacggaatctggacatacccgctggatcaagtttgggaaggaattcaagctgcttatgccaagattaaggcagatgtccaaagtaagtaccatgtgagcttggatgaaattagttcaatcggtgtcagtgccatgatgcatgggtacctaccatttgataaaaacaaccaattacttgttccatttagaacctggcggaataacatcactgaagaatccgcagataaattaactgatttatttgattttaatattccacagcgatggagtattgctcacctctaccaagcaattttaaacaaggaaccgcatgttaaagatgttgattttattacaactttagctggctatgttcactggaaactttcgggtgaaaaagttttaggaattggggatgcttcaggagtatttccaatcgatgatcaaacattaacttatcgtcaagactttattgaaaaattcaactcattaccagaagttgaacaatacccatggcaacttaagaatattttgcccgcagtcctggtagctggacgcgatgcaggtcacttaactgctgatggagcaaaattacttgatccaagtggaactttacaagccggtagtttgatggcacctccagaaggggatgcaggaactggaatggttggaactaacagtgttcgaaaacggacaggaaatatttcagttggaacttcagccttctcaatgaatgtgttggatgctccattaaagaaactccaccgtgatattgatattgttactacgccaaccggtgatccagtagccatggttcatatcaataattgttcctcagatatcaacgcttgggttggattatttagggattttgctaatgcaattggagccaagatcgatactaatacgctttacgagaccctatttgattcaacggttcattccgacccagatgctggtggattgattaattatagttatctttctggtgaaaatattaccaagattcaagaaggccgtcccttatttgtccgtactccaaatagtaagatgaacctcgccaacttcttccttactcaactctatgcagcatttgcgccattgaagattgggatggatatcttactaaatgaagaacacgttcaaaccgatgtcatggttgcgcaaggaggactcttcgggacaccagttattgggcaacaagttttggcgaatgccttaaatatcccaattacaatcatgaatactgccagtgaaggtggaccatggggaatggcagtccttgctaagtatgctgagacttacggaaaagaatccctagcagattaccttgacgaaaaagtctttaagaatccagaaagtatgactcttacaccagaatctgctggcgtaaaaggatatgaaagctttattactcgttaccaagcaggcttacctgttgaagcattagctggtgatgacattaaagaacgtgaagagaaagggagtaaatagtacatgttagaagatttaaagaaagaagtttatgaagcaaatatgcggcttcctaaactaggccttgtttcctttacatggggcaatgtttcagggattgaccgtgaaaaaggattgtttgttattaaaccttctggagttccatatgaagagatgaagccggaagacatggttgttgtcaacttggatggtgaggtagtcgagggtgacttgaatccatccagtgatactcctactcacacttacctttataatcacttcccaaagattggtggagtcgttcatactcattccccatgggcagtagcatttgcagctgcacggatggatgttccagcgatgaataccactcacgctgatactttctatactgatgtcccagccgctgatgctttgacgaaggaagaaattgaagaagactatgaaggtaatacaggaaaggtaatcgttcgttcattcaaggaacgtggcttggactatgaagcaaccccagcggcattagtaatgcaacatggtccatttacctgggggccgacacctgacaaagcagtttataatgccaaggtgttagaagttgtggcagaagaagattatcatgcaatgcaattaacgcaccaagaccttcacttaccacaatacttattggacaaacactattaccgcaagcatggtgcgaatgcatattatggacaaaataatgcgcattcaaaagatcatgcagctcacgcttaattaatttggtagctacatttaaaaactttttaggataaaaggagtgtaatctcatggatattaagaattacgaattttggtttgttactggtagtcaattcctttacggtgaagaacaattaaagtcagttgctgctgacgctgaagacattgttaataagttaaacgaaagtggtaaattgccttacaaggttgtcttcaagggtgttatgacaactgctgaaggaatcactaagtttatgaaggaagctaactacaatgacaacgttgccggtgttatgacatggatgcataccttctcaccagcaaagaactggattcggggaactaagcttttgcaaaagccactacttcacttagcaactcaatacttgaacaagatcccatatgacaccattgactttgattacatgaacttaaaccaatcagctcatggtgaccgtgaatatgcttacattaatgctcgtttacaaaagcataacaagattgtttacggcttctggggtgatgaagaagttcaagaagaaatcgctgactggcaaaatgttgcggttgcttataacgaaagctttaacattaagattgttcgttttggtgatacaatgcggaacgttgccgttactgaaggtgacaaagttgaagctcaaatgttccttggctggactgttgactactggccagtaagtgacttggttgaatatgtaaatggtatcagtgaagaagaaattgatgctgcttacaaggacttagcaagtcgttacgaaatggtccaaggtgacaatactaaggaacactatgaacactcagttcgttaccaactttgtgaataccttggcttgaagaagtttatggatgaaaaaggctacactggctttaccactaactttgaagacttgcatggtcttgaagaattacctgggttagctgctcaattattgatgcgtgatggctacggctttggtgctgaaggtgattggaagtcagccggaatggatcgcttattgaagattgctgctgataatgttgctactgcctttatggaagactacacattagatcttcgtccaggtcaccaagcaattcttggttcacacatgcttgaagttgacccgacaattgcttcggataagccacgggttgaagttcacccattagacattggtggtaaagatgacccagcacggttagtatttactggtcgtgaaggtaaggctgtcgatgttaccctttcatacttcaacgatggttacaaggttattggttactcagttgattgtcataagccagaagctgaaacgcctcatcttccagttgctaagcaattatggacaccaactgttggcttaaaggaaggtgctgaacgctggatgcatgctggtggtggtcaccacacaatcttgagtttcagtttgaaaccacaacaaattaaagatcttttcggaatgttagatgttaaagttgattttattgaatagttaattttaattgaaaatctgtaaaatggttctactcggcaaacctcgagacgagtagaaccattttttatccggagatggaaaaatgaaaactgaaaaagagaaaatgctagcaggggaagtttttaacgtttacgatcccgaattagttaaagagcgccaatatgcccgtcaattagttgagcgctttaatgctcttggcgagatgaacccgactgcaagcaatactgtgattcgtcaattatttggacacgttggcgaaaagtgtgaggttcattcgcaattcaagtgtgattatggttataacatttatgtagatgacgattttttcgctaattatgattgtgtcatgcttgatgtcagtccaattcgaattgggaagcattgtttattgggaccgcgagtgcagatttatactgtcaatcatcccctggacccacgattacgacgcaatggagcttacggccaaagtaaggatgttaccattggggatgatgcgtggattggtggcggggcaattatttgtccaggtgtaactttgggtaataatgtaattgttggtgctggaagtgtagtgacaaagtcgtttggtgataatgttgttattgccggcaatccagcacgaatcattaaaaagaatccatatgtagaataattgattatttcccgggttatttttaacgcaaaaagggaactaagatatggccatgtgacggccgttatcttggttccctttatcattcttaatatttaaggttatattcgtaaactagtgctggttctttacctacgcgtgtaaagttatttaagttattaatagcagtcatttcctcgtcgcttaatgtgaagtcatagatgttaatattttgcttgattcgcgcttcatgaactgactttggaatgaaggcgaccccgctttgcaaatgccagcggaggacaacttgggcggcagacttatgatggttagcagcgatcttattgagggttggattgtcgaggatggttccacgcccaagcggactccacgcctgagtaataatatcatgttccttatcgtattggagcaagggttgttgatttagatgaggatgacgttcgatttgattgatgacgggcatctcatgtgcttgggtagcaagatactgaaggtgaatcatttggtaattgctaacaccgattgaacgagtcagaccttccttttttaattcttcaagggctgcccaagtatcaaagaaagcgcgctcaattggccaatgaataagtaaaaggttaacataatcgagtttcaacttttggagggagtccttaacagagtcaatcgtttgcttaaacccttgattaggttcagatacttttgtggtaatgaaaagttcctcacggggtaaaccaagctcctgtaaagcatttccaacctctgcttcgtttttatataattgcgcggtatcaaaaagacgatagccagcatcataggcatactttatcgcggaggtaatcgtactttgatcagtaattttatataagccaaatccttcttgaggcattgattgaccatcagcaagtaataattgttttacatcgttattcattggaattctcctttgtaataagcggagcagtagattgtcccttaattatcgttgggggataaacttttgaagtgacttcttcgcctgcaatcatttttaagatcattttcccagcatcttcacctagttgacgtttggggtgattagctgtagtaaggctaggggagataatttgcgccatttcatagttatcaaaacctattactgaaatatcagtcggcacttgtttcccctgtttctgaagatgactaataactcttgttgcaaggcggtcattatagcaggcaatcgccgtaatatcattattactattaagcatcatatcgacttttttgataatatcttcatagtcttcgcttgattgatacataataacatttgatttagtggtggggatgttgttatcttgataggctttgatcatcccagccatgcggtcaacgccttgttgatcatctatttggaatactcctaaaatattagtatgtccgaggctaaagaggtatttcactaattcctcctctgcttcccgatcttttgtcagtaaagaaggaaaatcgaagccaggataagtggagtgaaataggattgttggaattttatatttctggacttgacgataaagatctaagttaggattaggcatggcgctttcagtcggctcaataattaacccagcaatttgaagatccaacatatttaagattgtttggcgttcgcgtttatggtcattaagcgtatttccgacaatcattgagtaaccttgttctgttaccacactatcaattccagaaatgattggagggaagatatagtcagccatatgagtgctgattaccccaatgattttattcttttcactttttgtccaatcgcgttgccagtcttgaacaaacattccaccaccttgaatacggtaaatataatgttcgttttcaagatcgccaacagcgcgacgaattgtataacgtgatacattaaaacgtttcattaaggcactttcagttggcaatttttcattgattttatattttccatcgataatttcgtttcgtaaagtttgctttactgtttcatatttcacttccaatgctttgcgctcctatcttaataaaattagttttgaatatataaaaaatgctccatataattagcaacccgctaacgcttatgaagcatttgattgattttatcttgatatttagaaccgacgcttctttggattttcgattggtttgttatccaaatcggtccgtactactagaacgtcacaaattgctgttcgagtaacaaattcggtaacagaaccgatcaaaattcgttcaacagcgtttagcccagtagcaccaatcatgatgaggtcagcacccatttcctttggcatgtcccgagcaataattgtctttggagcaccatattcaatggagtaactagcattttcaacaccgtgctctttagcatagtcgatgtacttgtctaaagttttctttgcagtttctgtaacttgttcaaccattgaagtatcgaaactggaaatgttttggaatgcacgtgtgtcaacaacgtgaagtaaacgtaactcagtgtctgcaccattacgttttgctacagcaacagctttcttaaaagccaattcagcttctttagaaccgtcaacaggaactaaaatgtgtttgtattcttgtgccataattgtagtgccctcctgaaatctttatattgtatacttattatacactttttcactattgagcgtaaagcgcctacgaaacattacttgcgatgatttatacgaaaatcagcagtgattgcgaaagccattaatgtttcgctgacacagccgatgattaccataataacgaggaatccggtattgtttgtccatccggaaatgatgcttagaataccgacgatggtcatcacaattccccaattttttaattgtggagctagatatttgcttttagtagggtcaaaaacaagaaatggcttatggatgtgagttaagagaaagattccttcaaaaagagcaatcaaaccaaacagggtcattagaagtggtaacaacataaaaatctatcctatctataatgaaattaaaatgagggtgagaaaaagcaaaaatctttctcaccctcactaaatatgtacgaaaactccgttggtgccgttaattgtcattcagtgttgacctgtgtttgagacaggtgggacacggctgcctaatattcaactaccaagtgtaaaggcatgttgtccaaaaggcaatacactagtcccaaagtaataagactgtaaggcaaacctgcgtttagacaacgcgtacactacagaattttcacttttataatagcatttttaagtggttggtgcaattatttgctcggatgatgtttaccccgtaaagtatgttgctgggccttccgtaattgccaatattggcggcctaaactggcttcaaaacgaccattatttttgggttggtagtattgggcatctttgattcgatcgggcaagtattgttgagctacccaatcttggggatggtcatgggggtaatcataatctatcccatgacctaacttagcagctcctttataatgggcatctttaaggtgagctggaacgtcaccaaagccaccttggcgcacctgagcaagagcttcgtcaattgcattaattcctgaattggattttggtgacaggcataattcgataacagcatctgctaagggaattcgtgcttctgggaagcccactcgttctgcagtttgaactgccgtaacagctcgttgcacagcaggcatattcgcaagcccaatatcttcataggccgtcaccattaaacgtcgtgcgatgataggaagatcaccagcttcaattaaacgagcaagatagtggagggccgcatcagtatctgacccgcgaatagatttttgaaaggccgagatgacatcataatgagcatcgccatctttgtcagcggataacgcctttttctggacgctttcctcaataatcggtagcgtaagatgaattttcccatcttcacttggatcagttgatttggcagcaagttctaatccatttaaggcacttcgaagatcaccattggtcgctgctactagttggtcctcggcgttttcttccaggactaatggtaaattgcccagaccacgttctttatcaactaatgcatgctggatagcggtcttcatttcagcagttgaaagcgggtgaactggaaaaatttgcgtccgactgcggatagcgggattaatactaatatatggattttctgttgtcgccccgatgaggataattcgtccgttttcgaggtgcggaagaagaaaatcttgttttactttatctaaccgatggatttcatcgagtagtaagatcaccgttccgctcatcttagcttcttctgcgacgatttgtaaatccttttttgtatcggttgccgcgtttagttttcgaaaagcatatttagttgaaccagcaatcgcactggcaatgctggtcttaccagttccaggaggaccgtatagaatcatcgaagaaagcatttttgctttaaccatgcgtgagatgatcttacctggtccgacaaggtgttgttggccgaccacttcatctaatgtccgtggccgcattcgataagcaagtggttgttgcatatattagccacgatcctttctatggaagaggtggtggaaaaagctttggtgttgatcattggttttttcagtcgtactattatttgaatttaccagattaggatatcgctttttgacgtcgactggtgattggtaaacagctgtttttgccgccacgacaactgctaatgaatccaggtcagttttatattctggatcagtttttaatgtaaactgggcattatctttagcagcagtttgaatgtatggatgaatttcgtcgtgagggagattaccgttgataaaaacaaggttaccaattccacgatctaactcggcagttaatgcctttgtccaatcttgttcctgtagttcttgaacactaattgttagacagacgcgttcacggaatgttccgaggtattttcgctgttcatcgggcttgatttttggtgtaccgtaaacagcattgtcaattcgctgttgagcagcacttttttcttgttcagacatattgaacgcctccttatcatgcaattgtaacacgaaatgcagaaaactatatttcttgataatattataatttttgttatatcatgactatgaagaaacataaagtaggctaacatataagggaagtgattattatgtttagtgcagtattttgggttttagcattttggtttattgtcaatctagtctggacaatagcgcgtcttaataatcggatgatgtcaagaacgtttgcctggataaatgtagtggcagtagtaattggcttttggacattttatgctgccagcaatggcgggggcggaattgctccttggtttcggttgatgaattggactaacattgttcttgccatttttcaattttataatggatactgtccacatcaatatggtaaaaaatcatagctctaattaaaaaggcgaggttggaagaattcttcttccggcctcgcctttgatgttttattttacaatttcacagaattcgattgtttcactgttagggccttcaatgttgaagaacttaattcccttatcccagaagtcaaggtgttgaacttcattgtcctttagtttaaaaccttcagctttagcagccttgaaagccgcgtccacatcgctagtattaagggaaatgtggttaatagcgcccgtttcgtgaacggcaccgtcgccagtccagatttctaaagtgaggtggccatattgcatgaaaacaacttcatttccctggtcatcagtatcaaattcaccaagcttcttgaaaccaagcttttcccaaaaagcaattgtttttgccatatcatcggttggaatcccaatgtgttgtacatcgtcaaagtaacctgctaaactcttgttaaatgccataataaaatcactcctgtataaattttaattaccaatatcaagtgcctggtgctttaatttagggaagatataacggtctgcccaaccagtaattgcaccttggaaggcaagggcaaataatgttcctaatccaaagttgtaaataccgccttgcatgaatgcagcaataattgccataattgttggtggaatgtatgataaccacatcgcaattgttgcgttaccatggcaataacggaaacgaataatttggaaaaggtcatcagcggggtgtaacacgaggttgacacgctgataaattgaaatggcggttccgatgaaagcaactcctaagaagttaatgaaaacatataggataatcatcggtaaggtagtggcgtccggcataattcggttaaagatgtcagagaaccactggataaaaatagaaaatggcaacatgaaaataaaattaccaccaattcgtcgccagtcccacttatgcatcaaaattgcgttgaggacagaagttaacatccctaagaccatgaaagcccagaaaagggtcattgaattattccctaaaacggcaatccctaggttgttttctgcggctgtccaataagcggagccaagaaattgtgggtggacgtgtgaacttgtaacaagtgttaggacgttccccattgagttaataacaattgacagtgcaaagtatgcccaactagcagttaatgaaattgttcgctcggcaacttgaccttgtactggaactttttcttgttccatttatattctcccttccaacttgaccaatcatttggtgaagttattcactttctctctacgatgaattaatttacaaccatcaaaaaagcttgtcaagcgcttcacaagctgaaataacgggatttatcctataccaaaattattgaaacgatttactgaaagcgcaaacattaagtgggcataggaaacataaatctaattagaccaattagctgaaaaagcttacaaaaaaattttgaaaggatgagatatgtgaaaataatcatttctccagcacgaacaatgcaagttgatactgactccttactttacaaagatttgccggaatttcttcagcagacaaaagacattttagggtggatgaggagtttatcttatgatgagttacacaaagtatgggggaattgcagctcgcgtttagcgatgaaaaattatcaatggctccaacaaatggatcttcaacgaaagctgacgccagcgattattgcttttactggtctgcaatatcaatatatggcgccaagtgttttctcggaggatgggctgaaatacgttcaagacaatttacggatattatcaggattttatggtattttacggccgtttgatggaataataccttatcgcttagggatgggtgacatggcgccagtgaatggatataagaatctttatgacttttggggagaacaactttatcatgaactctataagaataatgatttagtaattagcttagcctcggtcgaatacgaaaaggcaattactccttatctacaaacgcaagatcgatttattaaatgtatttttggcgaagaaataaatggaaagataaaacaaaaagcaacattagctaaaatggctcgtgggaacatggtgcgatatttagcagaaaaccaaattcaaacgattgaaggcgtcaagcagtttaatatcggcggttaccgttttcgggaagatctgtctactgatgaaaaattagttttcgaactggtaaagtaaaagtaatcatattatttgccaatctttttgaattgtcttataaaagaattgtatacaaaactatccacattgcactgattctattaaatttttaatgatagaagggagccaaattatggtaggcgattctttaaataagacaggtgccaatttattaatcaaggccttgcaagagaataatattaaccgaatgtatggaatagttggaatcccggtaaccgatttagcgcggctcgctgaattacgcggaatgaaatattatggttttcgccgtgaagattcagcagttaatgccgctgcggcaactggttacttaacgcaaaaacctggcgttgcattaactgtttcagcacccggttttttgaatggattaacagctttagctcaagctactaagaattgttttccgttgattatgatttcaggttcgtctgaacgccatattattgacttatcacagggcgattatgaaggcctcgaccaatataatgcggcaaaacccttctgcaaaaaagcttatcgggttgatcgagcagaagatatgggattagctgttgcaagagccattcggacagcagtttcaggccgccctggtggtgtttatcttgatatcccagctgacacaattgttcaagaagatgatgctgatcaatctagtttgggtgtttataagttagttgatcctgcccctaaacaggtacctaatgatgaagcaatatcacgagcggttgatttaatcaagaatgccaaaaagccccttattattttaggaaaaggggctgcctatgatcggaccgaaaaacaagtgcaacaattagtagctgaaacgaatattccatttttgccaatgtcgatggcaaaagggctaattccagatgatagtcctcattctgctgcagcggctcgttctctttcactgcgaaatgctgacgtagtaattgtaattggtgcccgtttaaactggatgctttcatatggggatgcaccacaatttaacccgcatgcaaaatttgttcagctagacatcgatgccacgcagtttgattcctcacagccaattagtgccccgctccaaggagaccttaagtcgattttagataaattggttccagcactattggcaactggatatcaagcgcccgaagaatggttagagcaaattgcacaagatactgagaaaaatgacaaaaaattcgcgcaacgaattgctaatggtaaagtagcacaaaattttggctattatggagcaattgcgcctattgctgaatacttccaacaacatccagatacctatctagtcagtgagggggctaatacgcttgacattggacgagatatgattggaatgcaactcccccgtcatcgactcgacacaggaacttggggcgtcatgggtgttggccttggttatgcaattgcggcagcagttgaaacaggaaaacatgttgttgcgcttgatggcgatagtgcatttggttttgatgggatggagattgaaacgatttgtcgatataagttgccgattacggtcgttattatcaataatggcggaatatataacggaatcggccaagttgttcctaatcaacttgggccaactactcttgatccaactgccaggtatgatttaatggctaaggcctttggtggtgataattattttgtaagtgattacgatgagatgaaaaatgtttttgcaagagctgttgactcggggcgaccaaatattattaatgttcaaattgcaccatcgatgggaaaagaatctggccatattgggaatctaaatccaaagcttaatttacaaccacttgaagaaaatgagaggagccatcataatgactgaacaaagtgaaaatgcaccattaaaaggaattaaagttgttgactggacgcaggttcaatcggggccttcttgtactcagcttttagcatggctaggagcggatgtgattaaaattgaacggactaataccggcgacccaactcgtaatgaactgcttgatattaaagattcatggagtctttattatttacaattaaacgcaaacaaaaaatcattaactcttgatattaaaactccagaaggtcaaaaaataatgtatgacttactcaagaaggctgatgtctttgtggagaatatcaggcctggtgcggcgactagagcaggctttggctggaaaaaagtacacgaattaaatccacgtttaatcatggcctcgttaaaagggtttaataagggatcacgttttgccaatgtaaaagcctttgaaccggttgcgcaatctgctggtggtgcggcttcggcaacgggatggaatgaaggagatgcaaatatcccaacgcagtcagcagcggcattaggagattctaactctggaatgcatttaacgattgcaattttagctgctttgctacaacgagagcatactggtaaagggagctatgtttatcaatcaatgcaggatgcggttattaacctttgtcggattaaattgcgggatcaattgatgttagacaatctcggcgcattgccattctatgcagtctatcctaactataaatggggaaaagcaattcctaggtccgaaaatagtgaaggtgggcaagtgattggctggacttataaggcaaaaggttgggaaacggatcctaatgcctatgtttatattaatgtctttagacctagttgagtgcgcgagcagagcgagtgcacgaaacaaaaaaccacctgctatgcgggtgggcgataaaaattatataaaaaaggcctcttttgccttaagatgtaggtgttcaagccaaagtcaataagggaaaagaggttatataaatatggctaataaattaaatagcttagcccatacgaagtggttatgtaagtatcacatcgtattcataccaaagtatagacgtaaagcgatcttcaatcaataccgaagagacctgagagattatattcgtttgttgtgcaaatataagggagtagaaataattgaaggtcatatgatgccagatcatgtgcacttgttagtaagtattccgccgaaactaagtgtctcgcagtttatgggatacttaaaagggaaaagtgcattaatgatgtttgatcgacatgcaaacttaaaatacaaatatgggaaccgacatttttgggctgaaggctactatgtgagtacagttggattaaatgaatccacgataaagaagtatatccgagatcaagagaaacatgatatagcaatggataagctaacaagtgtggaatattcggacccttttaagggtaagtgaggtagtataaacaccgcttaaagcggtggcaaagtagtcagagcattttggcttgagcaaagcgaaagccagcgccttgagacgccggcttttattatcggcttatagccgatgtgcaaaccacccgtttgacgggtggttatgattgttattcaaaataaaaacaaaagctgggagacaattgctaatacgatgggtcatcctgaatgggctactgatgaacgatttaaggattgggaacatcgccagctccataaacaagaaatttacccattgattgaatcatataccaagaattacgataagtatgagttaactaaaaaactcggagcggctggtataccagtcggcccggttttagattggcatgaactcgaaaatgatccagatttaaatgaagatggtaccctagttaagattaatcagggaggaaatcgcggcgaatttaagacggtggggatgccgtttacgatgtcaaactataaaccaacctataagcgagccccagatcttggtgaaaataataaggagattctatcttcgcttggttatgatccggaacaaattgaagaattagtagctaagggcgtaatctcaaaagtagaaaaacctcataatccgcggacaaaagttattaaggattaactatggtttatgctgataaaagaaaagagatcggaaaattgaatttttcggtctcttttacatgtgcgcccggcatgggtattagctaggcggtgagagtccgctatgggccgtagtagtcggaaccatgagctgaggacaagggtgtccactgtgaggtggaatctgaaggaagtctaaggcaaagtactgcaccgatgaacaagaagtagctataaggctggaactaactggataagactgcatgacaagttaaagtccaacactactcgaagttactttcagtaaagctaccggtgacatggtacgaaagttaatatccttacccggggagatctggcctacacgtttccgacaagaggaataagtttaatttccacagaaacaagcggtgcagtgatgtagcgttgagtaagccagaagtcagccgaggtcatagtagtctgagtaatcagatgaaggactgaacgacaataacttgtaacttatatcggaggtgtaatcaggtgcgacaatcgcagaaaacagaacaacaagctgaccgcttgtcgaggataggtttggaaaaccgaaagtacacaagggcgcgtagtaccgattatggtgaaggtaaaggtatgagtgtcactatccaagacttagtcttggaccgcaataaccttaatcaggcttatttgcgagttaagagaaataaaggggcagcaggcattgacgatatgacagtcaatgaccttctgccatatctcagagaaaataagacggaattgatcgctagtttgcgtgagggcaagtataaaccagcaccagtcaaacgggtagaaattccgaagcctaatggtggagtaagaaaactcggaataccaacagtggtggaccgaatggttcaacaagctgtggcccaaattcttacacctatctttgagcgtgttttctctgataatagttttggcttccgccctcaccgtggggctcacgacgctattgcaaaagtagtagatctttataatcaaggttatcgaagagttgtcgacttagacctaaaagcctattttgataatgttaatcatgacttgatgattaagtatcttcaacaatatattgatgacccatggacactaaggctcattcgtaagtttctaactagcggagtcttagaccatgggcttttcgctaagagtgaaaaaggaaccccacaaggagggccattgtcaccaatactggcgaatatctatctaaatgagttggataaagagttgactagacgtggtcaccactttgtgcgctatgcggatgattgtaacatttatgttaaaagtcaacgagccggagaacgagtaatgcgaagcattacccagtttcttgaaaagcgattgaaagttaaagtgaacccagataaaaccaaagtcggtagcccgctacggttaaagtttcttggcttttcgttgggtgtagaccacaatggagcctacgcccgtccagcaaaacaatcgcaacaacgagtaaagaaagcattgaggttattaactaaacgtaatcgtggaatatctctgacaagaatgtttgaagaaattcagcgaaaaatgcgtggatggcttcagtactactcaattgggaaactaactgactttattcaacgccttgacaagtggttgagggcccgaataagacagtatatctggaagcaatggaagaagcttaaaactaaggtaactaacttacagaagctggggctgtcccagcgtgatgcatacgtcttcgctagtacccgcaagggctactggcgaactgcacacagtaagaccttgagctattctctaacaaatagaaaactggaacaactcggacttatgaatatgtccaagacgctccagtcaattcaaagtgattaagttgtcgaaccgccgtatacggaaccgtacgtacggtggtgtgagaggtcgataattgaactaatcaattatctcctactcgatctttaaagctatcttagtcttctgtattgttcgctttttgcggatgtttatattagtttctaggttgttttagaattatttgtggtataaaacgaatattagtgttgaaaacccgacgattatatgcaataatcacactatcatatttatttggggtgtgtattttggaagaaacacgaacaatcgactttttcgaccgaacttttcatttgtcagagaataatacgaacattaagcaagaatgtttagctggattgacgacttttgtttcaatggcctatattctttttgttaatccaagcgttttaggggtagccggaatggataaaggggcggtttttactgcaactgctttatcagcaattattggctgctttttgatgggaattttggctaattatccaattgcgattgctccaggattaggtgataatgctttctttacttattcggttgtattggcaatgggaattccgtggcaaaaggcaatggctggtgtttttgttgcctctgtcttgtttacgatcttgtctttccttaaagtgcgggagattgtaattaatgctattcctaaagatttgaaatacgcaatggctgcgggaataggaatatttatctcctttgttggtttgcagggtggtggaatcattgtttcaagtaaatcatcattagttgaattaggatcgctgacggttcctacaacctggattacaatttttggaattttcttgattgcaattttaatggtcaaaaaggttccaggggcaatttttatcggcttagttgcaacaacgcttcttggtttattaacaggattggttaagatgccggatcatttaatttcaatggctcctagcttagaaccgacttttggagtagggattaagttcttgccaacaatgactgatccgaagatgtgggctgttgtcttaatcttcttattggtagctttctttgacactgctggaaccttagttgggttagctcaagaagcaggattaatgaaagataataaaatgccccggattggtcgggctttaatggccgattcgctttcgatgttaggaggggcggtaatgggaacaaccccaacttctgcatatgttgaatcttcagctggtattgcggttggtgggaaaactggtctgactgcgattgtaacaggaacgctttttattttaagtatggctttttctcctttacttgaagttgttactactcaagtgaccgccgccgctttaattgtggtcggagtattgatggtttccgccttgaaagatatcgaatgggataaatttgaaattgcactaccgtcattcttggttgctattggaattccgctaacttataacatttcttatgggattgcatttggttttcttacgtatccgatcttgatggttgctgcaggacgtcgcaaagaagtaaatgttgtaatgtggagcatgttttttgtttttattgcattgctgtatattttgaatgttttaccgaaataaaaaacaccctaagattgtttaaagctcaacaatcttagggtgttttaatttatggtgatacataaaaaaggcattcccaattctcggagaatgccttttttagagttgaactaacaagtaatacctagtgattacttgttgtagaattcaacgataagagcttcatcaatatcagcgttcatatcttcacgtgctggaatgcggttaagcttaccttcaagcttgtcggcatcaaagtcaacgtatgaaggacgagaaacaacagcttctacagcgttcttgatgatgtctaagttcttagacttgtcacgaacggcgatgatttgaccaaccttaacttcgtatgatggaatgtcaacacgcttaccatcaacagtgatgtgaccgtggttaactaattgacgagcttgacgacgagtagtggctaaaccaagacggtaaaccatgttatcaagacgacgttcaagcaatgccataaagttggcaccgtgagtaccttccttaatcttaccggcacgaacgaaaaggtttgagaattgacgttcagtcataccgtacataaaacgtagcttttgcttttcacgtaattgtgtaccatattctgaaagcttaccgcgacgatcacgaccgtggtcaccaggagcgtaagcccgacgtgctaattctttaacagtacctgaaagtgaaacgccaagacgacgtgaaacacgccaacttggaccagtgtaacgagacataaataaattcctccaataattttagttggagtaaaataatccgattgtgagcttggcattcgtgcaggctgatttgaatctttcaccctagcagccgggttactaaaaacaccgttaggcaccagtctgttgacgagcttgcccctcactgctgcattattttacacaaaatctagtgtacaacggttcgtaataataagtcaatcttttctttagaaacctcgtaacttttttagcagaatgatgaacaatataaaagtttatcaaacgtagatgttttttcatatcttttaaagcacgttcattgtggtatgctataattttgaataggattatacggataattattgtgcaagagcaataaacaataaaaagtagtaggtggaaaaagtggtttttcaagtattgattggtattttaattattgttgtagcaatattagcttgcgtatatttttatcaacgacgagctgttaaacagatcaacgacttaatggaaagcgagaaaaagctagcagatcaaaaagttgaccagcagattaaaaatgttgaagaattgcaactaatcggggatgctaaaaagcaattcgaaacaactaaaaacaaatatgaaaaacaagtgcgaccagcaatcacggcctttaataaacgagctcctcaattgttagcagattcacggacgagcaagttgttgacaatcaacactcagattcgtgacctgcaagcagatttggcaaagttaacgacaactcttcaacagatccaaaaagacttacaacatcttcgtcaacaacaacatacccataagcaagcggtcgagcagattaaaaataaatatcgtcaattccaccggcaactaaatgagaagagcttcgaatatggagacagtgaaaagcagttaaatagcagattaaacgaattagaggatcaattcgcgcaatttactgatttaactaataaaggcgatattgaggcggctcaagaaattttaagcaatttgcaatctgaaaacgacaaatttgaacaagaccttaagaagattcctcagctctataagccaattgcaaccgagtttccagaacaattatccgagctaaaaagtggttatgagacactcgtaaaacaaaatttccactttacggagaaaaatattgataagcaaattgagcaactccaagctaaactggatcagacgattgatcagcttaacaatttacaattagatgttgtggaacaatctaataaagatcttagtgaccagattgattacttatacggggtaatgcaaaaagaaattgatgctaagaatgaagctattcatttgattgaagtgatgaaagactttacaaaacatgctcaacggcaaaatgacgaacttggtgtagaattagaccggttaagtttgaattacacacttactaatcatgaacaagaaaccgttcgagaacttggtgaacaaattaaggcgattattaagcagtatcgtgatgacgcagaagcagttgccaataaaacggctgtttatagtcaggtgcttgatcgacaaaagtctaatcaaaagaacttgactgaaattgaaaaaagccaagaaaagcttaacgatgaagttgctaaattacagactgatgagcaacgcgcccgtcaaatgcttcaaaaatattccacccagattcgtacaattcatcgacaagtagaacagttgaaccttcctggcttaccaaaggattacttagattacttctttggtgtcagcgatgagattaaaaagttagctgatgaattgaatgagtataagatcaatatggatgaaattacgaagcaactaattatcgtcgagtcagacctagacacattaaatgacaagactgatattcttcgtgatagcgcggaattaacagaacgattccaacaatatgcaaaccggtttagtgataacgaaaagattgcagcagcagctaaaaaatcccaagaactttttaagcagtttaactacacggcaagtttagaggcaattgcgacagttttagaggagattgaacctggtagctacaaacgaattgaagatacctattatcgtgaaattggtaaaaattaaaagaattgagaggaaattgggcaaagaatcctggtttcctcttttcttattaaatgatagtgataattaatgcctaatagctaattttctgttataatataaaaccgttttaagaagagtcgaaatcttcagcagtagcctatcctatactgttgaaatcataatcagagtaggttacccatttgtaacaaccctgtgtattatttttaggaaggaatttagtatgatctattttgataatagtgcgacgacaaagatactaccggatgttttgtcgacatacgaaaccgtgagccaaaagatttgggggaatccaagcagcttacataattttggtgaaaatgcttggaaccttcaagaacaggcacgccagcagatcgcaaagctattcggggttaagcctagtgagattatttttactagtggtggttctgaaggagataactgggtaatcaaaggaactgcaatggctaagtaccgttttggcaaacacattattacgaccagtgttgaacatgcggcagtaaaaaatgcattggagcaactaaaagacttcggatttgaagttacctacctccccgttgataaagaaggacgaattaatcctgctgatgttaaagctgccattcgtccagatactattttagtgtctatcatggcggttaataatgaaattggaacggttcagccaattaaagaagtgggagaaatccttaaagattatccaaatattcactttatggtggatgctgttcaggctattggtaaaggattagatgaccaagtatttagtgatcgcgttgattttgccactttttctggtcataaatttcatgccccacgaggaactggttttgtttatgtcaagagtggccgtaagttagagcccttgattgctggtggtggtcaagagcgaacactacgaaatgggacagaaaatacaccgggtaatgttgcgatggcaaaagcaattcggttagtaaaggaaaatgaagcggaatcagtaaaacttgaacaggcaatcaaagaacggatttacgaccatttaagtaaatttgatcatgtgaaattgatttctggccgtgatcaaggtttcgcttcccatgtactatgctttgcaattgtaggggttcggggtgaaacgattgttcatgcctttgaagacaaggatatctatatctcaactactagtgcttgctcgtctaaaaagcattccgaagccggaacattagctgccatgaaagttccagaagatattgcgacaagtgcagttcggattagtcttggggatcaaaatacccttgaagaagctgatcagtttaataaaacatttgatgaattatacgctggctttaagaaaattattgaataaaatctgaaaggaggacataacgtgcaatatacagaaatcatggttcgttatggtgagctttcgacaaagggacataataaaaagtcctttattgatcgtttaggggtaaacgtacgaaaggcccttcatagctttgaccaggtaaaggtgcatgcccaacgtgatcggttgcatgttgaattaaatggagctgactatgatcaagtgatgaatcggttgaagttagtgtttgggattcaaaacttctctccatcaattaaagttgataagacgtttgaagcgactgcagaggcagcagcgcaaatgatcgctgaacaagttgataaaccaattacctttaaagtggaaactcgtcgatcagatcaccaatttgcaattgatacctttgaaatgaacaacaagctagggggatacctcttagataagtttcctgataaattaaaagttgatgttcaccatccagacctaactttacgagttgagatccgtcttaatgggattttcctttcaagtgaaacgattaagggtgccggtggtttgccagttggtactgctggtaaaggaatgatgatgatgtctggtggaattgattcaccagtagctgcttaccttgggatgaagcgtggtgtttcaatggaaatggttcacttctttagtccgccatatactagtccccaagctttagcaaaggccaaacaactaactgaacgtcttgcaaaatatagtggaagtattaagtttattcaggtgccatttgctgaaattcaagaaacagtaaaggaaaaagttcctgaaggctacttaatgacaattcaacggcgaatgatgcttcggttggcagctgccttaatgattaagcgtcatggcctggctatttttaatggtgaatcattaggtcaagttgcttctcagacaatggaaagtatgctggcgattaatgatgtaacttcttatccggtattgcgaccagtattgtcatttgataagaccgaaatcattaaaattgcccaagatattgatacttatgatctttcaattcttccatatgaagactgttgtactgtctttacaccgccatcgccaaaaacccggccaaatgttaagcgggctcgtgaatacgaaaaacgacttgatattgaaggattaatgcaacgagctcttgatgggattgaaattacggaaattcatcctggtgaagattatttaaaccaaaatgaagatgtttttgctgaattactttaattaggccttgacgaggtttgataatttagctatgatacactttaataagcattgaccgaaagagtagtaaagcggcacctaaaaagcgagatcctgatagtgagagaggattagttaaactttatgaaggtagttcgggagctgatatactgaaattaatagtaggtatgtccggttcatttaccgttatgaaatgataaagtggagtattttatactcaaattaggtggtaccgcgatgattcgtcctatcgattgtgatagggcgtttttttagttaatgcacaaaataaaaatgaagattgttttctgaaaggagtttctgccatgacagaaaaagatatgtcaaccaagtatgatccagcggcggttgaagaaggccgttatcaatggtggattgaccaaggattctttaaaccaagtggtgacaaaaaagctcatccatattcaattgttatcccaccaccgaatgttactggtaagttgcacttaggccacgcttgggatacaactttacaagatatgatcattcgacaaaagcggatgcagggttatgatgtattatgggttcctggaatggaccacgctggtatcgctacccaagcaaaagttgaagcccggcttcgtaaacaaggaatttctcgttatgaccttggtcgtgacaagtttgttcaacaagtttgggactggaaagatgaatatgctgatattattcaccagcaatgggctaagatggggatctctgtggattatgaccgcgaacgttttacccttgatgaaggattaaataaggctgttcgaaaagtctttgttgatctctacaataagggcttaatttaccgtggaacttacatcatcaactgggacccacaagcacggacggccttatcagatattgaagttattcataaggatgataagggtgcattctaccatgttaagtatccatttactgatggaactacttttaacggtaaggattacatcgaaatcgctactactcggccagaaacaatgttcggggatgaagcggttgctgttaaccctaatgatgaacggtacaaggacttagttggtaagaaggtcatggtaccgcttgtcaaccgggaaattgagattattgctgacgactacgtaacacctgaatttggtactgggatggttaagattacccccgcccatgatccaaacgactttaaggtaggtaagcgtcacaatcttcctgaactgaatacaatgaacgaagatgctaccatgaatgaaaatgctggtaaatacgaaggtatggaccgctttgaagctcgtgaagcgatcgttaaggaccttcaagaccaaggttacatgttgaaggttgacccaattgttcactctgttggtcactcagaacggacaggggtacaagttgaagctcgtctttcaacgcaatggtttgttaagatgaagccattagccgaagcagctcttaagaaccaagatactgatgaccgggttaatttcgttccagaacgatttgaacacacctttacgcaatggatggaaaatattcatgattgggttatttctcgtcaattatggtggggtcaccggattccagcttggtataacaaacagactggcgaagtttatgttggtatggaagctcctaaagatgccgaaaattgggaacaagataaggacgtccttgatacatggttctccagtgcactttggccattctcaacgatgggctggcctaatactgattcagcagactttaagcgctacttcccaactaacactttggttactggttatgacatcatcttcttctgggtttcccggatgatttttcaatcgcttgaatttacgggtcgggcaccatttaagaatgttcttctccatggtttgattcgtgatgaacaaggacgaaagatgagtaaatccttgggaaatggtattgacccaatggatgttatcaagaagtacggggtagatgccctacggtggttcttaattactggttcaactcctggtcaagatattcgttttagctacactaagatggatgcagcttggaactttattaataagatttggaacgcgagtcgttacgttatcatgaaccttggtgagatgcctgctcctgtccttcctgataagagtaagtgggatttagctgatcggtggattttgagtcggttaaatgcaactgtaaagcaggttaacgaacagtttgacaagtttgaatttggtgaagctggtcgggcgctttacaacttcatctggaatgatttctgtgactggtatatcgaaatgaccaaggaaaaactcaataatgggactgacgaagaaaagaataatactaagaatattcttggttacgttcttgatcagactttgaagatgttgcatccaatcatgccattcgttaccgaaaaattatggcaatcaatgccgcatgatggtgaatcaattatggttgcagattacccagttgctaatgctgaacttgatgatccagccgcaactgaacaaatgaatagtttgattgaattgattaaggctgttcgtaacattcgaaatgaagctaatgcgccaatgtctaaaccagttgatattttggtaaaggttgataacgatcacttggctcagatgttgaaggataatcgtgactatattgaacgtttctgtcatccagaaaacttaactattggtaaagatgttgaagctcctaggcttgcgatgagcgggattttgactggagcagaagtttacatcccaatggctgaattagttgaccttgatgaagaacgagatcggatggaaaaagaaattgctaaacttgaaaaagaagtagaacgttcacaaaagaagcttggcaatgaaaagtttgttaataatgcgccagaaaaggttgttgaagctgaacggcaaaaggcaacggaatggcagcaaaaattagcagctgccaaggaacgtcttcaatcgctccaacaagcttagcgtcaatttatagtaggataattaacatttttaacaataaatgaaaattatatcattttattaaataggttagactactatgggaatgctattagctataacatttataaatatagtttaaaaatagattaaaaaaggaatcggcaattgtcgattcctttttttttagtatgaaaaagtaatcatacatcgcttgaaaatatttatctattgataaggattaaataactgataattaagcggtttatttaaaaattatttcacatatttgccatttatttattgtaattatttatcacaagtattatgattaattgtggagaaacaggaaacggtttcaactattctttttatcgatatacttcggagggaggtatttataatgactattcttagtctggcacgtttccaatttgctatgacgacggtttaccacttcttctttgttcctttctctattggaacagcttttatcgtcgccattatggaaagtatgtacgtttcaactaaagacgagacgtacaaaaaaatggcaaaattttgggggaatattttcttacttagttttgctgtcggtgttgttacaggtttgattcaggaattccaatttgggatgaactggtcagattactcacggtttatgggtgatatctttggtgctccattagccctcgaagctttgctatcattctttattgaatcaacatttattggcttatgggtatttacctggaaaaaggttaagccggggttgcaccttttcttcatttggatgacgagttttggttctttaacatctgctttatggattttaactgccaactcattcatgcaacaccctgttggttatgaaatcaagggtggccgtgcagtaatggttaattttggcgcattgcttaaaaaccctcaattatggtatgaatttgggcatgttatccttaatgctatcatgatgggtggtattattattgctggtttaacagcattccaacttctcaagaaccaaaaactttctgaagctaataagaagttttacaagaagtcaatgcgtttaggacttttagtatcattgattttctctattggtggaattgcgttaggggatgcccagatgcaatacttaatcaaagaacaaccaatgaagtttgcagctactgaagacgtattcacgactactggtaagcatgcaccgtggacaattgttggtattgccgatatgaaagaccatgaagtaaaaggcaatatcgatattccctatgccctaagtattttgtcataccacaaaactactggtgcggttaccgggatgaatgagctcaatgcccaatataagaaaaagtatggcaagaatcttgattactacccaccagtaaatacactgttctatagtttccggattatgtgtgcagtcggtgcttggattttcttagtttcattagttggattaattatgacaagggaaaagagcaagaaaccacttgcacaacgccgctgggcactttggtgtattgcaattaccactttcttaccatttatcggtaatactgctggttggtttgtaacggaatttggtcgtattccatggacggtttatggcttgtttacaattgctgaaagtgtatcgccaaatgtttcagttggatcattgttaacatcaaatattgtttactttgtattatttacaactcttgcaattacattaatttggttaattgttcttgagttacgtaaagatccatcggaagcaattgaacctaaattcaagaaggttctggacccatttgacaaggaggcgttctagatgagttttcttcaattattatggtttgtattgattggagtgctttttgccggcttcttcttcctagatggatttgattatggggtaggaatggcggttgaaacacttgctcataacgaatcagagcgtgatcaacttgtgcggacaattggaccagtttgggatgcaaatgaagtatggttaatcacggctggtggtgcaatgtttgcctcttttccatattggtatgctagtcttttcagtgggtattacttaatcttaatgattatcctagctggtttaattattcgtggagtttcttttgaattccgtaaaaatagtccaatgccacaaaaacggatttgggattgggcattagcaattggtagtgcaatcgttccatttttccttggtattatgtttgttagcatgattcatggaatgccaattgatgctaacggcaattttcacgcaggattctttgactatttcaactggctttcagttgttggtgggattgccttattgcttttaacctacttacatggaattaattatattgccttaaagacgactggtccggttcaggaacgagcccggaactatgctgaatttttgtactggattctttatgctggcgaagttgtctttgcattattattaatctttatgactgactttatggctgttcacccagttggtacaatcatcatgcttgtattgattgttggtttttcagtcttggctcaagcagaaacctttgctggtcatgaattggttgcatttatttcaagtgggttaaccttagtatcattggttgtattgatctttattggtcttttcccacgggtactaattagtagcattagtccgaaatacagcattcttattcaaaatgcttcctcaacagaatatacgttgacagtgatgacaattgctacttgctgtcttttaccatttgttttggcatatacaatctgggcttactggattttctgtaaacggattgcaatgccagctattccggaggttaaataaaaatttatgattgatcgactactcttcaaaatcgaggggagcagacatatcatgattaagcttgtggggctttatgtcctgcaagcttttcttatccttggtcagggattaagtttggctgctttactaacaggcttatggcagggacattctcttttgagtcaaatatatggcttaggtggattcattgcttgttaccttttgcgtcatgggctaaccgaaattgggaatgattggcttgataagtattcggctaatgctgcccaaaactttcgtcagcaattattaaaaaaagtctttgcgcttggaccagtaattgttcagcgggagggaaccgggaatatggtgactctggcccttgatggcattaaagaagtcgaaaattatattcgactcatctatagcaaggtgatcagcatgatgattattccagtcattattttggttgtctgtttttggcttgattggatttctggcattgttatgctgttagtttatcctttgattgttttattcatgattattttaggctatgcagcgaaggctaaggcagatcgacagtttgcagcttttcaaatattgtctaatcactttattgattctttgcgggggattgacacattgaagtactttggccttagtaagaagtattcacaaagtatttatcggtcaagtgagcgttttcgcaagtcaacaatgagtgtgattaaagtagcaatgttatcaacgtttgctcttgattttttcactacattagctattgcaatcttagcggtctttcttggcttacggttaattaacggtcacttattgctattcccggcactagcaatcttgattttggcacctgagtattttttgccgattaggaactttgcaagtgactatcatgcaacattgaatggtaaaaattcatttcatgcggttcggcgaattcttgagatgccattaccaaagaagccgactgttgaattacaccagtggacaggagtcgatgagttaagttttgagaatgttgagtttatgtatcctcaaaatggcagtgaattaacaaaccttgatttaactgttaagggaaaccaaaaaattggcattattggaatgagtggggccggaaagacaactttaattaatcttttaagtggctttttagcgccgacaagtggccaaattatcattcaaggaaaaaaagtaacgactttggatattcatgactggcaaaaacagattctctacattccacagactccctatatttttgcagatacgttaaaaaataatattgccttttatactccaaatgtcagtgaagataaaataaaagaagcgattcatgttgtcggcttagatgatcttgttgctgaattacctcaaggattagggacgatgattggcagcggccaccgagcattaagtggtgggcaggcacagcgaattgccttagcacgagcatttcttgatccagaacgtcgggtaatgatttttgatgagccaaccgcccatcttgatattgagaccgaactagagttgaaaaaaaggatgcttccgttgatggaaaataggttagtcttttttgctacccaccgtttgcattggatgaagcagatggactacattttagtgttgaagaatggcaagttaattgaacaaggaacatatcaacagttgcttgatgaacatggttactttacagaactgatggaccaaacacgcggaaaggagataacccatgaataagattcctttacttaaagcaatgaaacatgatcggtgggtgaaacccttcctgaagcgttacaagtggaccttggtattagcaattaccctggggattgttacctttatttgtgctagtggattgatgttcaccgcgggctatttaatcagtaagtccgcgacgatgccttttaatatcttgttagtatatgttcctatcgttcttactcgtgcctttgggatttttaggccagtgactaattattttgaacgattggttagtcataattgggttcttaaaatgacttctgcatttcggaaaaagctttatgattcgttagagcaggatgctgttttctttaatagtaagtatcgaattggagacattcttgggttactttcagaagacgttgcccacattcaaaatttatatttacgaacgatttttccgatgctagttgcatttgggctttatgccattatcgttattggaatgggaataatctctccactaatggggcttttaatgttagttctatttgggttaatcatcattgctgttcctgtgtggtcagtgcttgttaatggcgcacgccagcaactagaaaagcaatataccaataccttgtatgctgatctcactgataatatcatggggattacagactgggtatttgcggggcgcagtgcggattacctgcagcactatgatcaaagcgagaaaaacgtattagcatctcaaaaagcgatgaaacgttttgagcattggcgtgattttattcttcaggtaatgattttattggtggttgttagccttattatctggggagcagcgcgttttggcggtcattggggaggaagtgcaaattggattgcggcctttgttctttgtgtctttccccttgatgaagtgttgtctagcttgccagcagctgctcaagaaactaatgtatatacggattcattaaaacgattgaatgaactgccacaaccgccagctccttctaaggttaatgttgagattgccgctccttatcatcttaaaattacggatgtttattatcgctatcctaagacagagaagatgatcttgcgggggattaatcttgatgttaatccaggcgaaaaacttgccattcttggtcgcagtggggccggaaagagtacgttagctagtttaattcgtggagaccggaaacctacgtcgggcactgttactcttaataatgtgccaacagacgaatttggtgatgagatttcgaattatattgggatcgttcaccaatcaccatatttgtttcataccacaatcttaaataatattcgtttgggtaatgaggatgcgacagaggatcaagtatgggatgtccttgaacgtgttggggtggccgctatgattaagcgactgccaaaaggacttcatacgatggttgatgaggcagggctacggttttctggcggagagcgtcaccggttgtctcttgcccgcattttgctcaaagatgcgcccattatccttttagatgaaccaactgtaggcttagacccggtaacagaagaaaaggtaattgagacttttatggagcagttacagggaaaaactttgatttggattactcaccatttacaagggatagaaatgatggatcaagttgttttcatcgaggatggtaaaatttcaatgcaaggcagcccggcagaattacaaaaaacaaatgaacattaccgggcgttaaaaatggcagatgagggtatctagctaggttagaaatgttataataaagtaggactattgatgaagggatgaatagtaatgaaagaagttgttgtacttggagctggttacgctggcttaaagacggtcgtattattacaaaaaaagctaaaaaataatgttcatattacactagttgatcgtaataattatcattatgaagctactgatttacacgaagctgctgcgggaacgcaaagtgcttcaaggatcacttatccaattagtgatgttattaatccacaaattactacctttattcaagatgaagttgtaaagatcgatcctgataaaaagacagttaaacttgctggtcatgaagagctactgcactatgattattgtgtattaggactcggttttgtttcagaaacctttggaatccctggtgctgaagaaaatgcattaccgatgactaatgttaaagaagctttagcaatttatgaccatatcattgccaaaatgaaagattatcgtaccactcacaatcctgatgatcttcaaattgttatttgtggtggtggatttactggaattgaattggcaggggcccttgttgacgctcgagcaagttatgccaaaatcgctggagtttcaccagatgaaattaaaattacgctgattgaagcttcaacaagattacttccaatgtttagtgaaaaacttgctgaatatggggtgaaccttgttaagagccttaacgtacaactacttgatggttcacggattagcaagattgaacctggcaaggttatctacaagcatggagatgatgatgaagagtcccttaatgctggtacaatcatctggacaactggagtaagtggtaatccattgatggaagaatgtggctttgatgctaagcgtggtcgggtaatcgttactgaccacttaacagaccctaagcatgatgatatttatattattggggatgttgctgccgtaatgccaccggatggtaaacgcccatacccaaccactgcacaaattgccctagcaatggctgattacacagctgaagacattgttagccgtattaagactggcaagcatgaagctaagccatttacttacaagtccttaggaacagttgcttccgttggtaatacgcgggcatttggtgaagcaatgggtcatgaattacgtggatatcctgcttcagcaatgaagaaaattattgctgaccgttccttgttagaaacaggtggtttgaaagagctatttgctaaaggacgatttgacttatatcactagaaaatgaatgaggctgagaaaaaacttttgttttttcaacagcctcgtttttatacttatatgctaaaaaggtatggctataataaataaagggtgaaataaatgattaaaacttatgatgaagcattatcttttatccatggacgaacacaattcaagaaaattccaacactcacacggatgaaacgattcttggcagaattagggaacccacaaaaaggacttaattacattcacgttacaggaactaatggtaagggatcaaccgttgcaatgatgcggtctgctttattggaaagcggcctcactgttggaagttttacatcgccttttattacacggtttaatgaacgaattgagtacaatggaatcccaattagcgatgctgaccttttaagattagttcaaaaaattgctccagttgtcaaaaaacttgataatacattggaaacaggcggaccaactgaatttgaaattgatacagcattaatgttttgttatatggctgaaaaaaagcctaatgttgtattgcttgaagtaggaattgggggactatatgattctaccaatgtaattacgccagttgttagcgtgattacgacagttggctgggatcatatgaagtatttaggtgatactttggctaagattgcggcccaaaaagcgggaataatcaaaaaaagcgtcccggttgttttaggggaccttccaactgaagcgcgcgaaactattctcgcagatgcaaaggagaaaaaatccccgttttttgaattaggaaaagactttactgttcacaaacttaatggtcatcagttccacgcgaaaattcggtatcaaggaaaaaatctgaaaaaaatagaaacaattcttggcttgccgggcgactatcagatagaaaacgcagcagttgctttgatggctgttgagctttttatggagaagcatggactggcaattgatcgccgtgctttgattgcgggattagaaaatgctgcttggccgggtcgattagaagaaataaatactactcctctggtcttactagatggcgctcataatcttcctggtgttcaggccctagttcatactattaagaatgattttgccgatcgggaagtttaccttttggtggcgattctggctgataagcaatatgaattaatgcttggtgaattagcaagtttggggaatgttcacttaaccgtcactcactttgctggccccggtcctaaaaggccaagtgcagacttagcaaaggctattgctgatattccaactaaataccccatccagactattaacgactggcaattagggatcgggcaggtggcaagtcaaatgagtgcggatgatgtaatgattattactggttctctttattttgtttcagatgttcgtaaattctttttaaattaaaaagtgtaaaagcacaaattttccgtatttaaatatatagagtgtaaaaaggagaattatttatttatggaaaatgaagtgattaacgaatatacaaaattagtctggacggctattcctgataaactgggaacaaagaaacaggaattatgtcaacgtttcttacgtaagtgtcctactccattagcaattaaacggctttcacgtattgaaaaaaatgagataaatgaatgggcgccagaaatgcttaacttttttgctgccattgaattaggaaaaatagtaaccaaaagtcacgaagaaattatcggccatgcttattcgagcatcgaattaggccgcaagatggttgaccattttcaaagtgaggagcaagaaagtgtttgtattgcttgtacagatatccataacgagataattgattggaaaattttgtttgtaggcggcggatgcgaatgtattctttatcctgataagatttttcaatatgcgctccggtgttcagcccaaggaattattatgatccacaatcatccgacgggagacattcatccttccaagcaggacgaatctttcactcgccgcttagaacgaggatgtgagattattgggcttcatttagttgactttatgattgttggtcgcgatacataccatagttggcgtgaagctagtctcgttaatgagcttaaaaagtaaagaaacttttaatttattgcaataattacgctttctttgttcttattaatgtatattaatgttcgtatgtaccgagtggctatggtataatatgcacgatattaatttgattttaagacgaagggaagaagcagattgctaggaattggaacaaaaaatcttggcattgaccttggaactgctaatacaattgtctaccttgaaggtaagggtattgtattaagagaaccatcagttgttgctcgtaattctaagactaacgaagtaatcgctgttggcagtgatgcccgtgatatgattggacggacgccagaaagcattgtggctatccgaccaatgaaagacggtgttattgctgattacgacacaacagttgcaatgatgaagtattacattgataaagcgttaggaaataatggtaagccatatgttatggtatgtgttcctagtgggatcacggaagttgaaaagcgggcagtgattgatgctactcgagttgcaggtgctcgtgatgcttatgttattgaagaaccatttgcagcagccattggagcaggtttaccagttatggatccaactggtagtatggttgttgatattggtggaggtactactgatgttgctaccatttcattaggtggtatcgtctcaagtcgttccattcgaatggctggtgataagatgaatgatgcgattgttcaatatgttcgccaacatatgaatttattaattggtgaacgaacagctgaaaagcttaagtgggatattggatctgcatctgttgaagctgctgaagaaatgggaacaacacaagttcgcggtcgtgatcttgtaactggattgccaaagacaatgcaagtatctgcaaaagatgtttcaacggccctccaagatgttgttgatagcattattacggcaattaaaggaacacttgaagaaacttccccagaaattgctgctgatgttattgatcacgggattgtattaactggtggaggcgcattattaaagcatttgccagatgttattgcagatgcaactaaagtaccagtattcattgctaatgatccccttgactgtgttgctattggtaccggcgagtcattaaagagtattgatgtaatgaagaaaaagtaaaatgattctctgacaatgacgtcagcgatgaatcatcattagtactaactaatgattgacggggctgattgccaagcaggattgtttggcaggccccgtcttaattaccttgtgtaagcattggagggtcataatgcagaaatttttttccaatcgccgattagttattgctgtgataattctagttgtctgttttggactaatggcaggttctgtttctttacggaataggcgaaatacaccaccgatcatccaacaatttggaaatgatattgttggctttgttgatagtgcagttgctctccctgtaaattgggcacagacaagtgtgagttcaataaatgggttgatgaatacttattctgaaaaccgtgaacttaaacagcaagtaactgaattagcacaaactaaagtccgtgatcagaccttagctcatgaaaacaaacaattaaaacaacagttaaaacttaataattcaatgaccgactataatacagttacagcggctgtgttaatgcgcacaccttcttcgtggcaaagacaactcgtgattaataaggggcaatctagtggtattaagaagaatatgcccgttatgagtggtagtgggttaattggtcggattacagaagtaaataaaactaatagcaaagttgaattattgagtgataccagtgaatcatcaaaccgttttgcaattactcttaatggtcaaaatgggaaggtgattaatgggattatcaccggatataatgcaagaaataacgagcttgaaatgggacaagtaacttctaaagctaaaataaaaaaaggtacccgagtagtaaccagtggaatgggtggtgtgacacctaagggactttatgttggccgcgtgtcacgtgtcggtaaagatgattatggtctcgcccagaaaatctatattactccagcaacggactttaatgatattaatattgttacagttgctgaagcggcctcacaggagtgataaattatgtatcgtttatcacgcttaaaatatatattcccaattggtttatttgtatgtctgtttttggacggcgccttaagccatgtgtgggcaccattatttttcagttatccctattcaatggtgagtgaacttgtcttactatggttagtcttatcgtatttctttcaagatgatattgagattccattaattccatttgcaattgctgccggtgcagtttacgatttatacttttcgggaattttaggattgtatattttcttgtatccattagtagtcgaaataactaaaattttatctcgttattttagttcatcatttctttcgatgattatgattttctttgttgatattgtcatttttgagacctttaattattgggcatattatttagtaaatattactaatgttggttttggcgactatcttatttatacgcttgctccaacgttagcattgaatttaatttattttgttgtcctcttctggccaattcgcgcaatatatcgctgggcattagacgatgatcaaatttaaaattagtgcttgacacaatagatattccagtataggatatttacaacatcataaatgacagtgaacagactagtagagctttaggcattgcaaagagagtccttaatgatgggaagggatcaatgtttcggcttgaatcacatctgtgagttggccttctgaaagccatagtaggaagacccggggaagcccgttacagcgcggagtttattttaatgaactcactaaggctattattcgtgagaaaatagcaagatgaggtggaaccgcggaaacgccctcgtagccagtttaggctcgagggtgttttttgtttcattaaaatagacttattaaggcaaatattgcgaaatatttgtaaacatgaggtggaaccacgatgtactcgtcctctaggaggtatctcctagaggattttttcttttcctgttatttctattagtcaataatttaaggaggcaatagtaaatgtcaatgcaatatataagtgaaattctaccttcattattccagggggctgctcttacattacaaattttcttctggacattagttggatctctgccattagggattttggttagcttaggacttacttctaaaattaaacctttgaagtggatattagaaatttatgtttggttaatgcggggaacgcctttgctgcttcaactgatctttgtattctatgggttaccaattattggcattgtttttgaacgttacgatgccgccctagttgcttttattttgaattatgcagcttattttgctgaaattttccgtggtggtttccaatctgttgatcaaggtcagtttgaagcagctcgtgtcttacgcctaagctactggcaaactcttcgcaagattatcatcccccaggtaataaaaatcgttattccatcaattgggaatgaagttattaacttagtaaaagattcatcgttagtttacgtaattggtctcggtgacctacttcgagcaggaaatgtagcaacttcgcgggatgttacgcttgttccattgatgttagtcggattaatctacttgatccttgtaggaatttgtacattaattctacggcaagttgaaaaatgttatgcatacttcaagtaaaggagggaatctaaatgttagaagttcgagatttaaaaaagagttttggcgatcggcaaattttagatggggttaatttaacagttaaagatggtgaaattctttgtattgttggtccatcaggtgctgggaaaacgaccttacttcgttgtattactggactggaaactcctgatagtggtgagtttttcattaacggtcgtcgatttgaccctcagggaacagatgcagctgaccgagtaatcggtgtggtttttcaagactttaagcttttcccaaatctttcggtaatggaaaatattacgttagcgccgatgatggtattgaaaaaggataaacaagaagcaattgctgaagcacaaaaactgcttgaagaattaggccttaatacaaaaggaaaattgtacccctaccaactttcaggtggacaaaagcaacgggttgccattgctcgtgcattagcaatgaagcctaaaattttgtgctatgatgaaccgacatcagcgcttgatccaaacctccgaaaagatgtggctaatattattttaggattaaagaaggatggaatgactcagttaattgttactcacgatttagaatttgcggaagatattgctgatgatattttacgagtacaaccacttgatcaacgtcagaataaataaggagaggagaaatactgatgaaaaaagcgaaagcaatttggttacttattttattagtagtacctgttctccttcttagtggctgtgaaagtgtaacaaagcgtgctgatacgcaagatacatggaaccggatcgagcgacggaaaagagtaatcgtcggccttgatgacagttttgttccaatgggttttcgccaaaagaatggaaaactagttgggtatgacgttgatcttgcccgggctgtttttaagcagtatggaataaaagttgattttcagccgattgattggtcaatgaaagagactgaactaaaaaacggtacgattgacttgttatggaatgggtattctgttaatcctagccgtgccaaaaaagttgcctttagtcgttactatctagaaaaccggcagatattagtaactaaaaagaagagtaacattaaaaatttgaacggaatgacgggcaaaacactcggagtgcagaatggttcaacgggagtaactgttttggatgagaagccaaagttgttaaaggataaaataaagaaccatacaccagttctttatgatacatttcctaatgcattcattgacttaaatgcaaatcgaattcaaggaattttaatggatgaggtttatgctaattactatattaagcaccaaccaaatagtaattcataccgcacttatatcagcaaagagttgccaatggaacattttgcagtgggaatgcggaaaggtgacaagaccttaaaaaagaaaattaatcaaggtttaggtaatttgcaaaaaaacggtgaattacggaagcttaatgaaaaatggttcggtcaagatagtaactacttgggaccagataacgctaaataaaaagagcagggacttggaaaatagtctctgccctttattgtttcctacaaacaaattaataaaaatatgatgaatttacgtaatcggtttgtaatttagtcatatttaacgtatcattattcagtatgataattcgaatgtaactaggttgcagctagtggaacccctcttgctgcattttatattgaagggagaaagagaacgtggattttaatcttgctcgtggcgtggacttgcacattatacccacaaaacaatttaagatgaatcacgtcttaatagattttgcgactccgcaaacaccaacgaatgctactgcacgaaatttattggcaaacctattagagaccagcacgcatcgctatccaacacagacggctttggctcgtcaattggcatctttatatggtgcctatgttaatttatatgttaaccggctggggacattgcatactgtccgattacgagcgagttttgtcaataatcgctttgttgatgaagatttatttgaaaagattagtggcttaataaatgagatcattttccatccgctaatcgatgacggggaatttgatggtcctacttttagaattcaatctaataatttaaaaagtgcgataaagtctctttatgacgataaacaatttttggctaatcaacgtcttatggacttgtattaccaaaatgattctgtaatgaaggtacctagtttcggtcaaattgctgatcttgagaacttaaatgctaaaagtttagtttcaacgtatcattcaatgattaatgaagataaaattgatatttttgtgttaggtgacattgatccgatgcgtgctcagcaagttattgctaagttgccttttgaagatcgcgatattgttaacaagtcacctttatatcatcaagcattgtatgatcaagttcagagaaaaacagaatatcaacaagtaaatcaggcaaagttaaatttggcatattctttgcctgtctattatcatgacgccgattactatgctggcttggtttttaatggactttttggtggcacgccatattcaaagctttttacgaatgtccgtgaaaaagctagtttagcttattatgcttctagccggcttcttccattcaatgggattgtaagtgttcaaacgggaattcaagcgagtgatcaagaaaaagttcaaaatatgattcaggaacaattaatcgctttacaaaatggtgattttactactgagacgctaagtgaagttcaagatagtttgattaaccaataccgggcagggcatgatttggcaagtaatgttttggaacaacaattagttaccaaattagttaatgaatcggataagaactttattaccgaaataaaaaaagtaaccgtagctgacgttatgcgtgttgctaaacagatgaagcttcaggcagtttatttattaagtggtgagaaataattatatggatagagaagtttatcaaaattttaaccagtccatttaccgtgaacaattatcaaatggtttgaaagtccagctcttaccaatggaaggctaccataagacatatgctattttaacagcagattttggttccattgataatcattttataccgtaccatcaaaagaaggcgattactgttccagacggggttgcccacttccttgaacataaaatgtttgagaaaaaagatcatgatgcctttgacttgttcggtaaactaggagctgattcaaatgcctttactagttttacccaaacaagttatcttttttcgacgaccagtaatctccatgagaatttagatgttctattggattttgttcaagatccatactttactgcagaaacggtgaagaaagagcagggaattattggccaagaaattcaaatgtatgaggatgacccgagttggcggctttacttaggtattttaggtaatttgtaccccaaagatccaatgcggattgatattgcgggaacggttgaatcaatcagtcatattacaccagaaattctgatggatagttatcggactttctatcaaccaaccaatatgaaccttttccttgtaggacgcttagatccagaagaaacaatggcatggatcaagcaaaatcaagaacaaaagattttcgctcccgcagagacaccccaacggttatttagcctgaacgatccaactgcgcatgatgtaattccattccgttcattaacgatggatattgttcgtcctaaagtgatggtaggcttacgagggaccaagcaatttgatgatggtaaagaacggctccactacaaattagcaattgatcttttgttagatgttttgtttgacgatacttcagataactatttgcgtttgtacaacaatgaaacattggatgacacgtttagctacaactttgaaatgcaacggggctttcattttgcgtactttagctctgatactgatcagatggaacgctttgcagatgaggttattgatattcttgaaagtgctgatcagcaaattgaagcggcgcggacaaggtttgagggaattaaaaaggcagaactagggcggttaattggcttattagattcgccagaagcaattgctaatcgttatgctggagacctctttgctggcgctagcttgatggatgagatagcgaccttggaaactattacgattgatgatctttatcaagttgcaaaagagtttattactccgcaaggtatttcggtataccaagttgttccgcaacatcaataaactaaacttttcctatagatttattccgataagctaatatataattgagcatgatataatatccaagagtaaagataaatgaaaatggagatagaataatgagtgagaacgagaacgatcaaaaacgacttgaaatcggtaaaattttacgaaaagcacgggaagaaaagggctatacccttgatgaccttcaacaaatgactaagattcaaaagcggtatttaatcgcgattgaagatgaaaattttgatgaacttcctggtgacttttatgttcgtgcgttcattaagcaatatgccaatacggtaggcttagatggtaatgaattattgcaaaaatatgatgatcaattaccacagactaaaacggaagagtattccgatcatttagctcaagcggttgaaactcgtgcgaaccaacggaagacggttagcgggagcgtagacaaggttcgtaactacatgccaacgattattattgcttgtgtgattgttttagtgttggcagcgatttggattacggccattgctcgcaaccatcgcgattcctctacacggattgataatagttcggtatctgtttctggagagagtcgtaagaaagccgctacctctgctaaaaaagcaagtacaaagcagagcaaatcgacagcaatcaagctccaagaagcacctaatcggaatgacacaagcgttacttatacagcaagtcaacttactaaagacacaacgctacaaattgaaccaagtgatcgttcatggatgcaggtaagggcaaataataatgacttattaaacaaaactttgaataacaatgaaaaaactagtgtaaaaataagtcgtgatacaacttcattagtaattacggtcggcaatgctcgagcaacaaagttaaagctcggtaatcaagaaatctactttactaataatggccgttaccaaaacacgcggaatgtaacgattaactttggtaatgcccaaacaagcagcagttcagcaagtcagtcagcaaatagttcaagtcaagcttcttcatcctcggctcgtcctaataatgctacgcaaccatctgctgctaataataacagtcgtcctcagacaagtgctagtcagcaaaataatcaaccaactcgttaatataagaggactaaaggagttagaacattgaatttaccaaataaactaactgttatacgtttaattattattccctttttcttattattaatggttctgccattacaaagctggggagctgtaagtttttggggagcaactatcccgatggctcagcttattgctgctattttatttattgcagcaacaattactgataatcttgatggacaaattgcgcgacggcaccatcttgtaactaattttgggaaatttacggatccacttgctgataagttgcttgttatgactgcatttatcgttttaactggaaatggtgttgttccatcatgggtaacttcaatcattatttggcgagaattatctgttacgggcttacgcttattgttagtggaacaagacggggtagtattagctgctaaaatgccggggaagattaagacaactactcagtttattgcaattatcttcttactcttaaataatgttatttttgctatttggaatattccatttggtcaaattatgttatatatttgcttgttctttactatttattctggagtggattacttcattcagggacgcgatgtcttttcggatggatttaaataggatatggagggtgagaaaaaacttttgttttttctcaccactcatgttttttatattcatagttttaagattttagtgaaaatgactatactttacgtatatatattaataggggatggagttttatggatgcagaaattatctcagtaggaactgaaatagtccttggacaaataattaataccaatgccgcgtacttagctaacagactaacccaacttgacttaccggctacctatcaaacaactgttgacgatcaatcacagaggttagagcgtgttattaatcacgctttgactcgtgctcaattagtttttgtttgcgggggtcttggaccaactgcagatgatattacgatgcctacagttgctaaaaccctagggaaagagttgcagactgacgaagaacactggaaatggattcaaaaaacatttgaacaacgacaaataaaaatggaaccagagaatattcgtcaagcccagtatccacgaggaggagagccgcttgctaatcctgtggggcttgctctaggatgttggtatgaaactaagggtaaagttgtggttgtcttaccaggaccacccgccgaatttaaggcaatggttgaaaagagcctggttcctaaactccagcaatattttcaaacaagaaaacaaattactagtcggacattaaactttttagggcggccggagtcacaattaatggatgaaattgaaggtgctactaacgatatcccagggataagcattacttcttatgttcaaccaacggcaatccaggttcggctcaccgtacgtgacttaccagtgattgaagctgaagaaaaaattgatcaggcacaaaaagcaattcttgcagttgaagaaccgtttttctttggagtgggggatgaccttacacttgccaaagtcgtcgttgaacaattaaaaaagcgcgggtggaaattgacagcagcagaaagcttaacaggggggatgttccaaagtgctatttgttccgtaccaggagcctcgactgtttttaatggtggttttgttacctatgctgctagtgcaaaggaaaagttattaggaattccccacgccacgattgaccggtatggggtagtaagctctgaaactgctgcgacaatggctgaagggtgtcaacgaaaattaaatgttgaagttggaattggctttactggtgtggcaggtccagatatgctagaaggacaaccggcagggacagtctggattggactagcaatgaaggggcgctcaactaaaaccgttcaattacatcttgcatcctatgttggaagacaggcgattcgtacattaagtgttcagtatggacttcaattaatttaccatgaactaaaaaaataaacgaacttttgttcacttttttcttgtttttttggctaaaactgttattattagttatcggataaaccgtaaaaaaggaggaatttgatttggctgaccaacgaaaagcagcattagatgttgctatcagaaagatcgaaaagaacttcggtaagggttctattatgcgaatgggtgatgccactgatatgaaggttgcttcagtttctagtggttcccttgctattgacaaggcacttggaattggtggatatcctcgtggtcggatagttgaaatttatggtcctgaaagttctggtaagactactgtagcattgcatgcagttgcagaagtacaacggcaaggcgggacagcagcctatattgatgccgaaaatgctcttgatcctcaatatgcagaagccttaggtgttaatattgatgacctattgctttcgcagcctgatagtggtgaagaaggattagaaattgctgatgcattgatttcaagtggagcagttgacttagtaattgttgattcggttgcagcattagttcctcgtgctgaaattgatggtgatatgggtgatacccatgttggattacaagctcgtttgatgtctcaggctcttcggaagctttccggtgaaattaataagacaaagacaattgctatctttattaaccaaatccgtgaaaaagtgggagtgatgtttggtaaccctgaaacaacaactggtggacgggcacttaaattttactcaactatccggatggaaattcgtcgtgcggaacaaattaagaatggtacggatgttattggaaataaagctaaagtaaagattgttaaaaataaggttgctccgccattcaaacgttgtgaagttgacattatgtatggtgaggggatttctaagactggtgaattgctagatatggcagttgaaaacgatcttgttgataagagcggtgcctggtactcatatggtagcgaacgtattgggcaaggtcgtgaaaatgctaaaaagtggcttaaggaacatccagacagcatgaatgaattaatggataaagttcgtgttgcaaatggaatggaaccgttaaatgaaaagtcaacgaaagaaactgctgatgataaagccagtggtaagaccggtgaaaataaacaagaaacaattgaagaagcaagtaaagaataaataataatatttgaagttgaaattccctaattttttagcattaatagctgaatattagggatttccctttttatgctggctgtttaagcaattgataaattcaatagttgacaccttagtgtggcaagattaaaatttaacttgtgtgatgtttttttgacgttacacggtgaaattaatttattcataccaacaacataatagttgaagcggaggtgaaatagtgaaaattttaatgttcgccgcgcttgctatggttgtcggaattattgtcggctatgtaattcgcaaggtttcatatgaaaaacaagttgcagaagcacataatgatgctaaaggtattatttctaaagcaaaacaagaagcagtaacggcgaaaaaagaagctattttagaagcgaaagaagagagtcatcaataccgcgagagagtggaagatgagttaaaacagcggcggagtgaggtccaacgacaggaagaccgattactccaacgagaggcttctttagatcataaggatagcgctctagaaaaaagagagaatgcagttggcgttcgtgaacgtaaattagatcaagaaaaagagcagcttcatcaatcaaaggaacaagcagaagccttaattgaacaacgcaaacaagaagttgaaaaagtcgctcaaatgtcacaagaagatgctaagcagttattattatctgaagtaaaagaacagttaaaaactgaacgagcagtaatgattcgtgacagtgaacaagaagcggaactttctgcagaacgtaatgcaaagaaattaattgttgaagcaattcaacgtagtgctgcggatgttgtctcagagacgactgtttcggttgttaatcttcctaatgatgatatgaagggaagaataattggtcgtgaaggtcgaaatattagaactttagagacgttaacaggtattgatttgattattgatgatacgccagaagctgtcgtattgagcggctttgatcctgtacgacgtgagattgctaagatcgcgcttgaaaaattaattcaagatggtcgtattcatcctgcacgaattgaagaagcagttgataaggctcgtaagcagatggatactcaactacgggagactggtgagcaagcattgtttgatctaggaattcattcaatgcatccagacctaattaagacggtcggaagaatgaagtaccggactagttacggtcaaaatgtcttagaccactcaatcgaagttgctaagttagccggaattatggctgctgaacttggggaagatgttacattagcaaaacgtgctggactcctccatgatattgggaaggcaattgatcatgaagttgatggttcacatgttgagttaggtgtagaactaacccgcaagtataaagaaaataaagtggttatcaatacgattgcctctcaccatggagatgtccctgctaattctgtaattgctgttcttgtacaagcagcagatgcaatttcaggggcccgtcctggtgcacgaagcgagtcattagaacaatacattcaacgtttaaagaaactagaaagcatagcaaacagttatgatggtgtcgaccatagttatgcaattcaagctggtcgagaacttcgcgtgattgtcaaaccgaagaagatttctgatttgcaggcaacaactttgtcacatgatattaagaacaaaattgaaaagcaattagaatatccaggacatattaaagtaaccgttattcgggaagttcgagcagttgattatgctaaataaactgatttttcagttcctataaagaggctgggtataaccttcagtctctttattattttaaataacatccatcattaacagagatcttgcagtaaatttagacaaaaaatataattagtttattattaacattaaaaaatatattaacggggtgaaacttagtggcaaaaaaaacaacaccgatgatggaacaatatcaaaaggtaaaagatcaatatccagatgcctttttattttaccgacttggtgatttttatgagctatttaatgacgatgcagttaaaggagcgcaacttcttgagctaacattaaccacgagaaaccatagtgcgaaaaatccgattccaatgtgtggagtgccccatcgcgcggttaacaactatattgatattttaattgataagggttataaagtagcaatctgcgaacagatggaagaccctaaaaaggcgaagggaatggttaaacgagccgttacccgcttaattacacctggaacgcaaatggatttaaatggtgaacaggcacgtgataacaattatcttgcagcgattagtggacaaaatggggtatttagtattgcctacaccgacttatcgactggggagcttaaaacgacaagcttaaataatgcaaatgatgcggtcaatgaattggttaatctccaaagcaaggaagtagttgtggatggtgagttgccagttgaaataacaactcagtttaagcaacgaaatatccttcaatcacatcagccaacggtccttaaaaatgctgagattagctatcttactcaagaccttgatgatcaagcccaacagcacgttgttgcgttacttgtgtcatacttattaacgacccaaaagcgctctttggcccatatgcaaaaagcaattgcatatcaaccaagttcttttatgaagatcgaccactattcaaaaacaaatcttgaattaatgcgcaatatgcgaagtgggaagcgtcaagggaccttggcatggcttttggatgagacaaaaacagcgatgggcagtcgtctccttaaacggtggattgaccggccgctgattaatcaaaatgcaatcagtgaacgacaagataaagtccaagagttattagaccactattttgagcgaagtaatttgcagcaagagttaattaaagtatacgaccttgaacgcttagcagggcgggttgcctatggaagtgttaatgggcgtgatcttattcaacttaagacttctttaaagcaagttcctaaaataaaatacgttttagaaacccttgattcacctgtctttgaagaattacaaaaacaattggatcccttggacgatgtggcagatttaattgatcaatcaattattgaagaaccgccaattgctgttactgaaggtggcgtaattaaggatggctataatgaccaattagaccaataccgtgatgcgatgaataatggaaaacagtggattgtggacctgcaagaacatgaacggaaattaacgggcataaataacctcaaaattggttataatcatgtatttggctattatattgaggttacaaaagttaatcttgataagcttcctaaagatcgctatgagcgtaaacaaacattagttaatgctgaacgtttttctactccagaattaaaagaaaaagaggcattgataatgggggcgcaagaaaagtcaacagccttggaatatgatatttttgttaaaatccgtgaacaagtcaagggacaaattacacgcctgcaaaaattagcacaacaacttgcagaattagatgtacttcaaagctttgcggttgttagtgaagactaccactttgtccgtcctgaaatgaatactggtcacgtattaaagattaaagatggtcgtcacccagttgtggaaaagtttatgggacaccaagaatatgtgcctaatgatgttttgatgggagaagatactgatattctcctgattactgggccaaacatgtcagggaagagtacttatatgcgtcagctagcattgattgcggtaatggcacaaattggctgttttgttcctgccaaatctgctgaattgccaatttttgatcaagtctttacccgaattggggcagctgacgacttaatctctggggaaagtacttttatggttgaaatgatggaagcaaataatgctttgacccatgccacagatcgtagtttgattctctttgatgaaattggccgaggaaccgcaacttatgatgggatggcattagctcaagcgattattgagtacgttcatcagcatgttcgtgccaagacgctattttcaactcactatcatgaactgacagctcttgagaatagcttggcgcggcttaaaaatgttcatgtaggggcaacggaaaaagatggggagttagtattcttgcataaggtaagtgcaggtcctgcagataagtcgtatggaatccacgtggctaaactagcaggaatgccatcctcattgttaaaacgtgcagatactattttgcaaaaattagagcaaaaggatgtaaaactaccgaatacgcctaaaccggcaacagataattaccatacagaaccaatatcagcgaagataaatgaagcggcaccggtaaagaaagaggctgcaccagtcgttgaagataatggtcaacttgaattatttgccactcagcctgagaaaaaagaatcgagtgttgatcggcggattttgcaccaattaaaagaacttaatttaatggggatgacacccatggatgtaatgaatcaaatttataagtggcagcagaaattgaaataaggtgatatttaatgggaaagattcatgaattagataatattttagccaatcaaattgctgccggtgaagtgattgaacgtccagcatcaattgtaaaagaattagttgaaaattcattggatgcccatagtcaccgtgtagatattattgttgaaaattcaggtttagacagcgtgcgcgtgattgatgatggtgacggaatcgctgctgaagatattagtctagcatttcaccgtcatgcaactagtaagattaattctcgccatgacctctttaaggtgcagacgatgggctttcgtggggaagcgttacctagtattgcttcagtcgctgatgtaactcttacgactgctcaagctggtcaagaagaaggaacaatgattcatttgcggggcggaaaagaattagtagtgaagccggctggtgcgcgtcaaggaaccgatattaaggtaaccgacttattctttaacactcctgcgcgattaaagtacttaaaatcacctcaaacggagctaaccagaattacggacatcattaaccgacttgcccttgcaaatccagcggttgcttttagctttacccataatgggcgggaattatttcgttcggcaggtaataataacttacagcaagtagttgccgcaatttatggcgttcaagcaggacgtaagatgcttgagataagtggtgcagatgatgattttaaggttagtggttttgtttccttgccagaattaacacgtgcatcacgtcaatatataacaatcacaatcaaccatcggtatattcgtaattttgaattaacaaaggccattattcagggatatgaatcaaaactaatggttggccgttatccgatcgcggtaattaacattgatctagatccagttttagttgatgtgaatgtccatccggctaaacgtgaggtccgtttgagcaaagaacagcaactaataaaattgattgctgaaacgattcggcagcggatagcggttgagaacttgattccggatgtcgatgctgaccaattcattcctaatgatgatgaggtagcggaccttgatcgccggttaaaggaagcatcacctgtttatcatgccgccccgatttcagcagtgccagcaacagagaaggcggcaactgagattccaactcccgaagctgataatccagcacatgctgacgcgcttgatagtgagattccagcaccgatcgttatccaccatcttgaagatttaaatacgcccgcaatgcaaaaatttgatgagcgttatcaaaatgaaggtgaagttacgccattttctgctccagttcccactatgactaagaagccagtaaaacctgcaaatattgaattagatgtccatgataaacaagatcagcagcaaaatcggtttcctgatcttcaatatattggtcagcttcagggaacctttttattagcacaagcaggagatggtctttacattgttgaccaacatgctgctcaggagcgaatcaattatgagtattaccgccaaaaaattggggaagtgagcgccgatcagcaaaatttcttggttccgcttgttcttaattattcgactgtcgatgcaatgacaattaatcagcatctcgatacgctggcagcggttggattagaattagagtcatttggtcagaatagttttattttgcgttcccatccaacctggtttaaagaggggcaagaagaagacacggccgaagaaatgattgattggttaattaagaatggaaaactaaccgttaaagaatttcgaatgaagacagcgattatgatgagctgcaagcgggccatcaaggctaaccaccaccttgacgaacgggaagctaaagccttgctgaaacggttgccacaatgtgagaatccttttaattgtccacatgggcgtccggtaactgttcattttaatgatcaggatttagaaaaaatgtttaaacgaattcaggattcacacaccccgtatgcggatgattttgatgaccatgaattttaaggaggaattaccttgtacgaatacttaacaggccttgtaaccgttgttgcaccacaatatatcgttgttgatgttaatggggttggctataaattattagttgctaatccctatcgttatcaagaggatcggactaagaaggtccaagtatatgtttaccaagcagttcgtgaagataatatttccttgtttggtttcacagatcaaaatgaaaaaaatctatttatgcaattaatcaatgtttccggaattgggccaaagagtgctttagcaattttagctaaccctgatcatcaagggcttgttgatgcaattactaataataatgttagctatttaactaagttcccaggaatcgggaaaaagacagcttcgcaaattgtgttagacttacgtgataagctcactaatgaaagcagcagctcactatttgcaacaactcagcttaccgttgatgcaacagtaaatcgtgagttgaaagatgctttggaagcattggccgcattaggatacaaggaacgggacattaaaaaggttcaaaaggcattaatgaaagaagaacaaatggcaaccgatgaatacttaagacaagcattaaggttgcttaactaggaggtgcaagacttgtggaaaatgatcatggtattttatcagatcacccatcaggagaagaagaaagccaagttgagataactcttcgaccacagaaactaagggaatatattggtcaacctaaaatcaagcacgaactagaagtatatattaaggcggcccaatcccgggaagaagcccttgaccatgtattgttatatggtcctccaggattaggaaagacaactttagcgatggtaatagctaatgagatgggcgttaatatcagaacgactagtggaccagcgatcgaaaagccaggagatttggttgctttattgaatgagttgaaaccaggggatgtcctttttgttgatgaaatccaccggttacccaaagttgtggaagaaatgctttattcagcgatggaagattactatattgatattgttattggtgagggaccaactgcgcaccccgttcattttccccttccgccatttacattaattggggcaacgacacgggccggaatgttatcggcaccattacgtgatcgtttcgggatcgttgaacacatgaactactatactcaagatgaactgacaaaaattatttttcgttctgccaagattttccatactagcattcaagatgaaggggcccatgaactatctcttcgttcacgtggtacgccgcgaatcgcaaaccgccttttaaaacgggtacgtgattttgctcaggtagcagggaaacaaagcattgattcagcaattgttaagcaagcattatcccttctccaagttgatgatcggggcttagatgagattgatcggaaaatgctattaacgatgatcaatttctaccatggaggtccagtgggattaaaaacaattgcggcaaatattggtgaagaaactaatacgattgaagaaatgtatgaaccatatctattacagattggctttattagtcgcacccctcgcggccggttagtgacaccgacagcgtatgaacatttagggattgaatatcctactgataaaaattgattgagggaaattatgtgtaagttagaatttacaattaatcaaagtgatcaccaagcacgaactgggcttttgcaggttaatggacgacaaattgaaacaccggctttggctgcaagtggagatgaattagcaaagttatcacctatccagcttaatcaggctggtgtaagcgtagttaagacaagtgggttaaagcgatggctaaaatatgattcgatgactgaaaaattaggagacctccatcgttttttccagtgggatggtcttttacttgtggacttggaaactgaggaggcctatcacttagcaaaaccgcgtggaaaaaaacacgatggcgttcggtttcatgatccggcaactagacaactaaaattctggcaaccagaaactgcccttcaagttcaagaagcacttggggctgatatttttcaaagttttgaccaggcaacagattattatgcgccagttgatgatctgaaagcaggggtaaaacaaactagtgactggttatctgttgttaagccccaaaaaggacaatcccttggttcgattggtgggggcggcttaaaagatttgcggacagccagtattaaggcggtcgatgaggctgagttaagcggctatcgtttgagtgggatccctaacaacttagatgatcaagagtttagccgaatcattaatgaaattacgcctaaactagaagaggagaaactgcgctacctccctgctgcactttcttttgaccaaatgatagaggcaattttagcaggagtagatttaattgatagcaatctagcagctaaaaaagcggcaaatgggattgcactagttaatcaaggagcgacagttcttcatcttgatcgtcaacattttagcttcgattcagaagtacttgatcgtcaatgtgcgtgtgcaacttgtcgcgcgggctattcaagggcattgctccatagcttaattaccaaccatagcttttacggtgaacaacttttgctgcagcataatctgtttaccctcaataaattaatgagtagtctacgacaagcaattaaatatcatcaaacaaaaaaatttgttcaagaattattgcagaatcaatagagcatatagctttttgcagtaaagtttgttaaagttaatattagttaactttttgaagggatggataaaccgtgaatagtttgagtagttttgttcttggtgctgcttcatctaataatgcaagtggttactcaggaattattttaatcatcttaatggtagcattaatgtacttctttatgattcgcccacaacaaaagcaacgtaaagaacaccaagagatgatgaatgaattacacccaggtgatgaagttgttacgattggtcggatgcatggtaagattgattcaatcaataaggctgatcggacagttactttagattgtgaagggatctaccttacttttgatatggtggcaattgcccgtgttatcaaacgagcagatgcaccagctagtgaagctccccaagataataaagctgttgctagttctgcagctgacagttctgcagctgcttcagcagatagcgctgctagtgagcctgcatctgcagcgagtgctagcgatgaacaaaaagacagcgaagaaaagtaatttaatttagatgaaaatagtcgtaaacaggcgaatattttcatcttttttatttggttgttaatcgcgtttattgctatactaaaagatagtgttaaattttattcgggtaaggagaatagcataatggcagatccattaacagcaatttttgaacaaatcaaaaaatacaataaaataattattcatcggcatcaacgccctgatccagatgcaattggctcccaagttggccttgcggaaattttacgggcttcatttccatacaagcaaatttatgttgtagggaagcatattccagggtttgattggatcggtgagatggatacgattgacaatcagacgtttgatgatgcattagtaattgttacggatacagcaaatgcgccacgaattgatgatcggcgctttgataatggggacgagcttattaagattgatcaccaccctaacgatgaaccctttggcgatattatgtgggttgaaccagatgcttctagctgttctgaaatgatttatagtttttatcaacgatttgcaaaagaattaacgcttccccagaaggctgcccatgccttatacgcaggaattattggcgatacaggtcgtttcctttatccagcaacaactcctcgaactatgctagttgcaggttcgttaatggcggccggcgcaaatgcagcggaaattagtcagcacgaaaatgaaattaccttaccagtggcccgtctatcagcatatgtttatgagaatttgcagatattagataatggagccgcatatgttatcttaaccaatgaaattttagagcaatttggattaactgaagccgggacatccgcaattgtttctttaccaggtcgaattcatgatgttattgcctgggcgatctttgtagaacaagaagatggccattatcgcattcgtctccgttcaaaggggccaacaattaatgaattagctaagcagcacgacggcggtggacatccccttgctagtggcgccaaggctaaagatgaagcagaaatcaaacaagtgattgatgaattggaccaattaacacaaagttatgcaaaccaaaaatgaaagggaaatagctatgagtgataaaaaatttgctgattttcagttacaaccttatctgttaacagcgattcaaaaaattaattttcgtcaaccgacaccggtccaacaacgagtaataccagtgattatggctggacgaagtgttgtagggcaatcagcgaccggtagtgggaaaacacatgcctttctcttaccgattttttcaaagatcaagccagaagatcaaaccgttcaagcagtaatcacaactcctagtcgggaattagcataccaaatttataatgcggccaagcaacttaataagtatgctcctcatcctcttaccattcacaattatgtcggtggtacagacaagcagcatcaagttgaccaattaagccgaaaacaacctcaattggtcattggaactccaggaagagtattagacttaatcaagagtcaggcattggatattcacacagcgaaaatgtttgtggtggatgaagcggacatgaccctagatatgggattcttacatgaagttgaccaaattgccagtcattttcctaatgaccttcaaatgatggttttctcagcaacgattccgcagaaactgcgcccattcttaaaaaagtatatggaaaatccagtcgttgaagagattcctactgaagcagtaattaatccagatgttgataattggttaatgtcaactaaggggcaagatcgtaaccagctaatttatcgtttgctgactcttggtgaaccatatcttgcgttggtatttgctaatacaaaagagcgagcagttaaattaacccagtacttagaaaatcaagggctcaaagtagcaatgattcatgggggactagaagctcgccgtcgtaaacggacaatgcggcaaatccgtgatcttgaatatcaatatgttgtagcaactgatctagcagctcgtggaattgatattgatggagtatcactagtaatcaatgacgacttgccaactgatcttgaatattttgttcatcgagttggtcgtaccgggcgaaatgggatgaagggaacagccattaccctatatgagccagcagaagacgatttgattgctaagcttgaggaacggggagttaaatttgtaccaaaagaattaaagaatggtcaactagtaactacccatgaccgtaatcgtcggaagcattataagcggcggcaaaatgaacttgatccgtcaatgaagggttacgtaaaaaagactaagaagaaggttaaacctggttataagaaacggattaaaaaggcgattaaagaagacgaacagcaaaaacgaaagctagaattacggcataaaattcggaaagctaagcgtgctcgccaaaagcaacatcgccgtgaacgaaatgcccgttgattttaaagtaattgttcgctataatatgacacgtctgggacatgctatagctaacggaaaattccagagacagttggtgaggtgtgacaactgatttcctagctttagtgctccccattcggataatttgatatttaaccttgggtaaccaagaagtaaagaggtaaacgaattccatcgttgcaagcagagtggtaccgcgtcaatccggcgtctctgattcgcaatggtggtttttgttttagaaagggcgatttgatgaaagagttaaagaagctaaatagtgctcaagtacggcggatgtacttgaagttttttgaagagcatggccaccaagttatgccgagtgcatcattagttccagtaaatgatccaacattactatggattaactctggagttgccacaatgaagaaatactttgatgggaaagttgttcctgataatccacggatgacaagctcacaaaagagtattcgaacgaatgatattgaaaacgttggtaagactgcccggcaccatactatgtttgaaatgttaggtaacttctctgttggtgattactttaaaaatgaagtaattccatgggcttgggaattactaacaagtgatgaatggtttggttttgatcccgaacggctatacattacttattatcctaaagaccatgacgcttacaatcgctggcgtgaagtaggcgttgctgaagatcacttaattgctgatgaggataacttctgggatattggtcaaggtccatctggtccagatacggaaattttttatgatcgtggtcaagaatttaataatttagccgatgatgatccagaaaactatcctggcggtgaaaatgaacgctaccttgaaatttggaacattgtctttagtcaatttaaccatacgcctgaagatacttatgaaccacttcctcataaaaacattgatacggggatggggcttgaacgggttgtttcgatctttgaaaatgcccctactaactttgaaaccgacttatttatgccattaatcaagcaagctgaagagtttagtggtactaagaagtatggtcaaaataaagaagacgatattcaatttaagattatcgctgatcatattcggacaattacctttgcgatcggggatggcgccttgccttcaaatgttggtcgcggatacgttattcggcggttgcttcggcgagcagttgttgctggaaagaagttgggaatcgatgaaccatttttagcaaagatggttccaacagtcggcaaaatcatggaagattactatcctgatgttcttaaaaatgctgactatattgcttcagttattgaatcagaagaagaccgctttagtgcaaccttaaatggcggattaaacttgttgaataacgtgattgctgaagctaaggaaagtaagaccaacgaaattgatggacgaacagcctttaagctttatgacacttatggcttcccaattgaattaaccaaggaatatgctgaagatgaaggactaacagttgatgaaaagggcttccaagcagcaatgacggagcagcaaaatcgtgctcgtaatgcccgtgatatggataacgggatgggtgttcaaactgatttatggacttcattcaaagaagatagcaaatatgttggctacactgatttgaccgttgataatgcaaaagttatcggcttagcacatgatggtcaacaagcggatgaagcacaaccaggtgataagaacattgaactaatttttgatgtaacgccattctatgcagaaatgggaggtcaagtcgctgatactggtgacattattgataactatggtaaaaaagttggccgtgtggttgatgtccaacacgcaccaaaccagcaaaatcttcatcgagtagaattaactgcccctattaaaaagggtgcccgttacaaactagttgttgaccgtattcgtcaccttaagattgaaaagaaccatacagcaacgcacttgttagaccaagcattacggaacgttcttggtggtcatactcaacaagccggatcattagttgaagaacattacctacgttttgactttaaccactttggtcaagtaactgctgaggacctcaagaaggttgagaacatggttaatgagcaaatctggaaggaaatcccagtcaagacagttgaaactgatattgattctgctaaggaaatgggtgctatcgccttattctcagataagtatggtgataaggttcgggttgttaagattggtgactttaacactgagttctgtggtggtgatcacgttaaaaatactaatgagcttggtctcttcaaaattgtttctgaaggaggagttggtgctggagtacggcggatcgaagcagtaacttctagtgatgcctttaagttcctccaagatcgtgatgacctcttaacaaagagcgctgctagtttgaaggttgctcagattaaggaagttcctcaccaagtagaaacattacaaaatgaacttaaagaagctcaaaagcaaaatgagtctcttcaagctaagattgctgctcaacaagctaataatgtttttgaaaacgttcaagcaactaagaatggaagtttaattgctgccgaagttcaagttgctggaatgggtcaattacggcaacttgctgatgcttggcgctcaaaggctctttctgatgttctagttcttgctacagccagtgatggtaaagcaaacttattagtggctgttagtgatgataaaactaaggaaggcttaaaagccggtgaccttattaaggcgattgcaccagccattaatggtggcggtggaggtcggccaaacctcgcccaagctggtggaaagaatccagctggaattaaggaagccttaagtcaagctaaaggttacctcgataagtaaatcaaaaatgagaaggaaataaccatctcatagtctaagagattgaaagaaaccaatttttgagttctttcaatctctttttgtaagaacttcttaaagtaataaaaaaatactatcaagaaatcctattatcagctataattataaaacttgtagtttgagataaaactaatattactgtttacttacaattgacaaatgtaaattgtgattttaataagaatatagtaaaattgatggttgaaaggaatatctggaggtgacgattgatggctacaaatgataaaacgatgttctttgattttggtcaagaacgtcaagaagatattaagcaaacattaaagacggtttatgaatcattagaagaaaagggatataacccgattaaccaaattgttggttatcttttatctggtgatcctgcttatattccgcgtttgaatgatgcacgtaacttgattcgtcaacatgaacgtgacgaaattattgaagagcttgttcggtcatacctaaagaataacggtgaaactaaatgagattaatgggattagacgttggctctaaaacggttggcatttctgtaagcgatcctctcggttggacggcccaagcagttgagattattccaattgatgaagaaaacgaaatttttgggattgatcgtgttgccgagctagtgaaaaaagaacaggtagctgggtttgtaattggccttcctaaaaatatgaataatacagaaggccctcgtgttgaagcatctcagcactatggcaagctattacaacaacgttttccagatattcctattgactttcaagatgaacgtttaacgacggttgaggcacaccgaatgctagttgaagaagcggacatttcacgtgctaagcagaaaaaagttatcgatgaagttgcagcaacattcattttacaaagctatttggatcgccatggccgccttgtgaataagctaaaatgaggtattaaaatgagtaaacaagaaaataacgaagacatgattacgttaattgatgaaaatggtaatgaacaattatttaaggaattgtttacgtttgattctgatgattatggcaaatcctatatctttatctatccagcggaacaagaaaatgacgattccgttgacattcaagcttacattatagctgataatgaagataacgatggacaggaccttgtcccaattgaagatgataaggaatgggacatggttgaagaagtattaaatactttccttgataatgatggcaacttcaaggcctaattaaaattactggataaataaaatattaacaaaagggagctgtagacacatttgtcacagtcctttttctttacaagcagaatgaaaggatcattaggatgattttaacaacctttattattttgattttaatggggtgctttattaatggtcatcgccgcggattattgacaatgacgttaatgctggggacatatatagtagcttggattgttgctcgccagggagcccaattgattggtggctggttaaaatcgttattaccaagtattggaaccccggcaactttttccgagagcttgcttgcaaatgtaaatagtaatcttttcttttataatgggattgcatttatgataatttttacaattgtttcaattctttgtcactggggaattcgtcagttaaactggataaagaggattccagtggtgggaacagttgataagatcgcaggtgggttaatctcatttttaattggctatttgattatttacgttgttttactaattatgcaattatttccagcaggttggtggcaaatgcaaatagcaaactcggaactagcgcgttttatgattaatcaaacaccaggaatagcgcatttagtaattgatacgctagtacagggaggataaaatgaatagcaaaattttagaaacattagaatttgatcgaataaaaggacaactggcacaataccttgtttctgccgctggtcatcgcgaattgacgcagcttgttccacagactgattatgaggcagtcaaagaacttttgacagaaactactgatggggccgatattttaaggttagaagatgggattcctattccgcaattagctgatatcaaaccgcaattgaaacgtttgaaaattaaggcaaatctgaacggcacggaattagctcaaattactaaagtgctgcaaactagtatgagtgtaaaaaacttttttgatcagatgcgggagaaaaaaattaaactacgggttttaactacccaagttgaccgcctagttacaattccttcaattacccagcggctagttcgttcgattgattctgatggacggataaatgatgaggcatcagctaaactccatggtatccggcaattaattacccaaacggaaacagagattcaccaacaaatggaaaggtatactcgtgggaaaaatgcgaaatacttaagtgaccctattgtcacaatgcggaatgaccgctatgtaattccagtaatcgcccgctatcgaaataaatttggtggggttgttcatgaccaaagtgctagtggacaaacattatatattgaacctgcagccgttgtggagaccaataatcggttacgacaagcgcaaatagaagaacggcaagaaatgcaacgcgtattaattgagttatcacaaatgattgctccttatcgacatgatattggtcagaatgaagcaattcttggacaccttgactttattaatgcaaaggcacgctgggcacatgatactaaggcaacgctaccgctcttaagcaaagaaaatcatgtttcattacggaaagcgcgtcatcccctgatcgatccccaacgagtagtgacaaatgacattaagattggggaagattaccaagcgattattattactggacccaacactggtggtaaaaccattacgcttaaaactttaggaattattcaattgatgggacaatctggcctatttattcccgcagaagaaggcagtacaattgggatctttgataatgtatttgcggatatcggtgatgaacaatcattggaacaaaatctgagtactttctctggtcatatggatggagtaaaagccattcttgaacaaattacaagtcgtagcttagtccttctagatgagcttggtgctgggactgatcccaaagaaggggctgctttagcaatggcaattcttgataatattggcagtaaaggaaccatggttgtaattactacccactatcctgaacttaaagtttatggttatgatcgtgctaagacgattaatgctagtatggaatttgaccaagaaactcttaagccgacgtataaattactactagggattcctgggcggtcaaatggattagagattgctcagcgattaggaattagtctccaggttattgatgaagcacggacatttgttagtgataatagtcaagaccttaacaatatgattggtgatttagtagagcaacggaaaaaagcacgtgaagaaagtgaaaagctagcaaaactagtagccaaaaatgaaaaagttcagcgtgaccttgatgagaaactcacccgctttaatgagcagcgcgataagctatacgaacaagcacgttcaaaggccaaccatcaagtttcgatggctaagaaaaaggctgaccgaattattcatcatttgcgccagttagaagttcagcagggcggaaatgtaaaagaaaatgaattaattgatgcgcaagggcaattaaacgctcttcatcatgataatccacggttgcaacacaactctgtattacaacgggctaagcaaaagcatgatttgcataaaggtgatgcagttttggtgaaatcttatggtcaatatggagaacttttatctaagcgagggaaccacaagtgggaagttcagattggaattcttaaaatggaaattgatgagaataatcttgaaaaagtagctaagaaagatcttccacgagaaaaagatgcaaagcggcgaccacgagctgctgtgagaacgacacaaacacgaaagacctcggctcgtcttgatttgcgcggtcatcgctatgaacaagcaatgagtgagctaagtaactttattgatcatgcattgttgaataatctttcaacggtaacaattattcacggaaaagggaccggtgctcttcgtaagggaacacaacaatatttgcaaagcaatccacgagttaaatcattctcctatgcttcccctaatgctggtggggatggggcaacaattgttaatttataattacttactataaaaaagtaagcaaattaaatgacatttaagaagtgatttgttagaatagcgttaagaaaaacaaaggaggaattgaagatggctgtaaacgtaactacagatcaaacctttgaacaagatactgccactggtgtcgatttaattgatttttgggcaacttggtgtggtccctgtcggatgcaatcaccagtagttgatgcattatctgataagatgcccgatattaaattttttaagatggatgttgaccaaaatccagaaactgcacaaaaattccggattatgagtatccctacattaatggttaagaaagatggtaaggtagtagaccaaatcattggttaccatagtgaagatcaattaaagcaaattttacaacaatatgttgattagaaaaaagctggagaaaaactttttgttttcttccagctttttcgtattttaaacttattttttatctttttttcgtcgctttagtagggaatgacgagtttcttttttgagggcgtcttctttttcgtcagggcgatcaacagtaatgaatgttaccatctcagatcgttcattatcagctgaactttgtggatcgttttgaatcaaaatatcaacataatcacggtgccagtcaaagatctttgcctctgcaaccgttccaagttgaaactctacttcttgagcaagaaaaccacactctaaaccaaaggaggtttcctcttcgtctctttgaatccgttcctttacaattacccctgataaccgccaaacttgagaagtattgctttttttacgtaaagctaaacggccaaagccaagttgattagtgagatatactagatcctcggctgtagcaacaggatatactcgagcgagatctttaccaatccaatatagcatttcatcggtctctttacccaggatagctggtaaaatcacgtcgcgcattgttccagctcctagtccttgatgaccggctattaactgattatataatttctgactcatatccactcgctcctttttaacaatcattattattatacttaaaattcaagatcttaatagggttaaacctgaaaaacttgcaaaatcttatggagaaacggataatatagtttcaaggttttaaacgttttaataaattaacgaggtgaagagaatggataaacgaccaatcggagttatggattcaggattaggcggcctatctgtaattcgtgtacttcgtgaacaactgccccaagaatctgtaatttttgtgggggaccaagggcattttccatatggaactaaaacaaaagaacagattcagcaattagcattacgtattggaaaattcttgttagaacaagacgtaaaaatgatgataattgcatgtaataccgcgactgcagcagctcttcgacttcttcaaaacgaattaccaattccagtaattggggtaattaaaccaggagccatggctgctacccaacatcattataaaaaaattggggtaattggcactgaatccactattaaaaatggcgcttatgctaaaacattagctaaacttaatcctgatctaagtgttatcagttctcccgcacagccacttgtctcaattgttgagcatgggcaaacaggaacaagtgaggcacaaaaagctgttgacactgaattagaagtatttgataaccaatcgattgaagctttgatccttgggtgtactcatttcccgtttttacaaaaagaaattcataataaattaggatctaatgttcagttaattgatcctgcatttgagacaatcagacaggcaaaggaattgttaactggcaaaaatcagttgagtgataatttagcgtcaagtatcaacctttattcaacgggagatgctaaagacttagttgctggtgcacaacaatggttaccaaacggatacagtaagtgtgcacatattgaattaaacgaggaaggttaaaatgaaaacaatcgtaatcgcaacaaagaataccgggaaagcgcgtgaataccaagagatgcttgctcccctaggaattgaagtaaaaacattagccgattttgcaccaataacaattaatgaaaatggtaaaacatttgaagaaaatgcaacaattaaagccactacagctgctaatcaactccaactaccagttatggcagatgattcgggcttaatggttgatgctcttggaggtgctccaggtgtacactcagcaagatatgctggtgatcatgatgatgctgctaataatgctaaactcttattggcgttaaaagaggtaccggatgaaaaaaggactgctcactttcatactaccatcgtcggaattaagcctgatggaaccaaattagttgccaatggtcgggttgatggccatattcttcatcaactcacaggaaaaaacggttttggttatgatccgcttttttatgttgatgaattaggcaaatcaatggcccaattaacagcagaccaaaagaatcaaattagtcatcggggacgcgcattacggtcatttatgaagcaatttaatgattggtggtaataaaaatgaaaatactagttgtaagtgataaccatcgagaagaaaaaattttgacagagattgttcaaaaaatggggaatcaagttgacctaatgattcactgtggggattcagaattagctcctgatcaggaaccgatgagcaattttaaggcagtgaaggggaataatgattatggtttgtcgtaccctaatgagttggtaattaatgctgggcaagagcagctctatctaactcatggtcatttacagcgggtcaatttttctctgacccctctgatgcttaccggccaagaaaaaggtgcctccattgtgtgctatgggcatactcatcagttaggagccgtttacgatcatcaaatgctaataattaatcctgggagcatcagttttcctcgtggtgaatatgctaaactcgggggaacttttgcaattgttgatgcgcagcctgagcggtttattgttgattattataaccgtcagatggaagctgttcctgaattacgttgtgaattcagtcgttagaaataaaggagtgtatttttgtgattgatcagcgtttgcaaactttattgctaaaaaacaagcagaagtttatgatccctgccagtttagttgcgacggtaaaccaaagtaatagtttagatcatgcattcttagtgcttactaaggatcggtacgctaaaattattgtgattgacaataaaaaccattattgcggtcagatttctttggcaatgattactgaccaattattggagacaaaacggatcaatgtggaacgcttaaatgaattaaaggtcagggatgtgatgcaaaccgatgcgccggttatccaagatccaactgatatcgaagaaaatttacacctcttaattgaccagtcatttttaccggtggtggacgatcataattacttttgcggaattgtgacgcgtcgtgaagtattaaaggcagtcaattatacaatgcatacttttggaaaataatgaaagtggctgtgacataagtcgagttactctcataaaaaacaaatagcgcagtacaacagaggcctccagcgcccggtaaaaccgaatgttggaggcctctttttatcgttcatttttaattaactggttaatagtctgcaagacgccatcatgattattatcaattgtggtggtgtgggcagcttgcatttgaataattggttgtgcattctgcattgcgtagctttgactcgtcatcgctaacatcccaaggtcattttcattgtcaccaaacgtaacaatttcatttgcctttaaattaaggtgggactgcaaaagggaaagagcgttttgtttagttgcagcagcattaccgattaagtcagtattaaagcctgaattttccatgattaaagatggcggtaagtaaccatctaaggttgttgtaactttttttagatcgatatgattagcaaaattaattgatatcttggtaaaatcttcagttggccgttgagtgaaaatctgccggatatcagggatacgctctacattttcataaaaaagtttcacaatgttgaaatcatgagcactcatcccctgatcgacataagatttttcactagtagagattactaattgattaatatcttgcggaccatagaaacggtcaagaacatgaataactcgggctaaagattcctgattaataggaaaagatttaaataatttgcttcctaaatggataactgatccgttttgcgaaataaatcccatcttggcggtgtagtctttaaattctcgttgcaaccgtggaaaactggatccgctagcagcgacaaagtagatattatggcgttcaagttgacgaaagacctttgcaaataaagaatgattgtaagtatggtcatctcgtaaaaaggttccgtccatatcagtagcgattaatttaatactcattaggtgctccctcccaggcaattggaatattattcgttcgtaattctttaagatatgccgccaaaaagtgactagcaacagttgattgttttccgctgactgctgttatcgtcacacgaaaaacgagcgcaccgtctggggtaacaactggtccgacaataactggttttaattgtagtgcctttatttgtggaactagttttttattaacctgcgtaacaatttcttctaccttactaagaggggtcttcgaagtaatccgaatatcaacgttgctaaccatattatttcgcgaaagattttgcacaatggtaatgttacggttaggaataaaattaagtgtcccatcggaactagtaacttgcgtagtacgaataccaagagcagttactgttcctttgatttgaccgatttggacagtatcgccgacgtctaattgttgctcaagtaggatgaaaaatccagtcacaatatcactaacaaggctttgcgcaccaagccccaatgctaaactaaaaattccggctccagcaattagagtacccactggaacgccaatttctgataatatagcgtacaataagaaaaaataacaagtataacgataaatgtttaagacaagggcttttaccgttgccattcgattgctattttttagtacattgtatttttttgattcttgaaaaagatggacaatgataactcgtcctacccataaaagtattaaaaataagacaaacgtaacgataattaaaagaaatttacttaaaagttgttgtgaaatttcgtgccaggataaatctgtaaaagctttttttaattgttccgtttgttttgatgtaagtgaagtggcaccagtgatcataataacctcctaaaaaatactaataaatattttaacagggaagacaagcttctgtcgactacactagattatcgtttttatttgttttatgatattcttagtattgaataagtattttgaaaactaaaggagggattatcagatgacttttggccagttggcagggttaattgcggcaatcgcattcctaatcttagtcatttttgcatgtatcctgttgaatcaattgagtaagacaatgaaagaaacaaataaaagtattacaactttaacgcgggatgttcattatcttagccaagaaatggaggacgtgctaagtaacacgaatacattgttagacgatattaaccataaatcagaacaactagatccagcggttaaagcagttgcagatgtaagtcagagtgtttcagaagtgaatgcttcacttcaagaaatggtcgagaaagcccggctgcaccgcgagaagcgacaatttgaccggagtatttttaagtttgcaggaaagacgcttgttttagatgctttcaacaaatttagacagcatcggaagcaaaagaaaggaatgacaaataatgagtaaaaagttacttgctgggatattattaggtggagctgcaacatatgctgcatggaagaaaatggcaccagctaaaaaagaagcattgaaagaaagcgttgatgaaaagattaataaagttgctgattatgtgactgattacaccttagacgcattagacattgttgatgatcttatgagtgattctaacttgaacgataaggtgagtggcgctgcagatgctgttaataatgttaagggtaaggtaaaagatagcgccaataaagtagttaatcatatgactaatgatgactttgataagcaaactgctgatattcgtgaggaattagcgaagaataaagaagcagatgaagataataacgatattattatcgatgctactagtgatcaaaaaccagcatctactgaaaacgatgaagcagaccaagatgacgctaagacagccgataaataagtaaaataaaaaagctgagagatctctcagcttttttattttaatgagggaaagttagtaattctttagttgtatgcgtgaatggttcacaaccatcttctgtaatatgaacacagtcttcaatccggacgccggcaaaacctggaatataaatgccgggttcaatggagaagcacattccaggttcaagaactagttggtttccctccataatcgatgggaattcgtgttcactgctacccattccgtgtcctaagcggtgaataaagtattcgccataaccagctgcagcaataatatcacgagcgatcttatctaattcttcagcggtcattcctggcttcgcagcatcttgagcaaccaattgagcttctaaacatactttgtagatgtctttttgcttgtcatttaactttccgacagctactgttcgggaagcatcactaatatagccatcaacaattgttcctaagtcaaagagaaccagctcattattttggatcttattactggaggtagctccatgaggttcggcagcatgaggacctgcttgaactagcgtatcaaaactcatcttgttaatcccgtgttgcttaagcgcatattctaaatcggcagccacttcttgttctgttttaccaatttgaattgattcgaatcctactttaaaagcaaaatcagcccattttcctgcttcattcaacttagcgatctcatcatcacttttaatcattcgcatttttgctatcaaaggagagagatcagtattaaaatgggcattagggaggacttcttctaaggcacgaagacggtcaacagttagtgattctccctcaattccccaattaattggggaaccagcgtgatttttgatatgttcagcaataagctcaaaaggtttttcatgatctaagtacccatatactggatatttccaaccagtatcctttattgcttctacttcaagagctggtgcaaacagaaatggctcactgtcggcaaaaaggactagtgctaatacccgttctactggatcgctgtagaaaccagttaggtaattaatggtcatcggatcactaatataagcagcatctaatcctttttcagcaagagcgctttgtaattgattaagttttgtcactgcattcacttcctaaaaaagattgcgaatattataacatattgttatgaaagtaaaaaaataatgaagaacgtttgctaattaaaactaaatctgctatattaactaggttatgaaaaaatatgaaaacagattataccaataaagaaagggctatcttatggaaaaacaatcagtaacaatttatacggttgcccgagaagctcgtgtctcaatggccactgtttcacgggtagtaaatggcaatccaaatgtaaaaccagaaactagacaaaaagttttagatgtgattaagcagcttaattatcgtcctaatgcagttgcacggggattagcttctaaaaagacaacgactgtcggggtagttattcctaatataactgatccatactttgcggaattagcattagggattgatgatgttgcttcaatgtataagtacaatatcattttaactaattctgattctgatgatgaaaagattctaaaagtggtgcggagcttgcttgctaaacaggttgatggacttatttttatgggtcatgatgtttctgatgatctgcgaaatgaatttgaaagcacaaatacaccagttgtagtagctggttctgttgttaatgatgatactttaccaagcgttcggattaactaccaagcagccgctaaggaagcgacagaatttctactaaagcatggtgatcaacaagttgcctatattactggttcattacgatactcaattaatggtaaagaccgactcgatggatataaagaagcattggcaaataataatgtggcatttaatgattcattagtaattgaaacagacggatcttatcaagcaggatatgcaaaggcacaagaagttatcgaaaagggcttaaaggctgcttatgtaacagatgatagtttagctgctgggctcttaaatgggcttacagatgctggcattagcgttccagctgattttgaactaatttcttccaatgacactaattatacaaaggttgtccggccaacaatcacttcaatcactcaacccctttatgatcttggcgctatttcaatgcggttgttgacaaaattaatggatggcgatgacagcaatgatgatgaaaagaatgttattttagatcatggctttgttgaacgccaatcaactcgtaagtaggttgtgatttgttgtgacaacccgaagtgaattgcgagcacaacgacaagaaaaagttgagaagccaatagaagaaacaccggaaaagcgtcattttctatactgcttatggggtgtaatctgcgtgactttactcgggctaacattactaattaattcgacactcttaaatgttaactttgtaaaagaagaagttacaagttcgtcgcttgaatcagttatgttaagtcaggttaacagtagtctaactcagtatgggatttcaacttctgtcttaaagaaaagtgatactgataagctaattaaccaggcgattgatcaagtatatgcaggtgaaaaaattaatcttgacctatcacctatagttaataatgtgggcacgtctgttaattcccaattagctcaatatggtttgtcgacgtccatgttaccagcaggcagttcttcagcaattgctggtaacattaattcgatggttaacagtcagttaaatactcccgaagttgcacagttaattaatgggattaaaattgctaaaacggttgtcaatattattttagtgatttcaattatcagtctcgttctattgatccttaaggggttatggcagcaccacttaattggtagttttagatggatttgtttgtggggaactgttttatatacaggaatcgttatgactattcatgcgattacccttcaaatgggtgcaggacaaccagacataagcccctttatttcccaggttgccaatgattttcagcagactggatttcatggttcaatgatgctgattgtcattagtattgtgttatttattctgcaatttgtaaaacgaaaatggcaacctcgccaataaccttgaattaacgatgaatatttgctaaaatttatctgtttgtattacattaataaagaaaagaggagtcagtaatgtcaggacattcaaaatggcataacattcagggacgtaagaacgcccaagatgctaagcgtggtaagattttccaaaagatttcacgtgacttgtaccaagcagctaaagcaggtgatcctgatccagcgaacaacgctcaattacggcttgtaatcgataaggcacacgcggccaacatgcctaagaaaaatattgaccgtgctattgctaaagcttcaggtattggtggagctaagttcgaagaagttacttatgaaggttatggaccaggtggggtagcagtaatggtttctgctcttactgataacaagaaccggactgcatctgctgttcgttcagcatttagtcactctggcggttcattaggtgctagcggatcagtttcatacatgttcgaccgtaaaggattaatcgaaattcttcgtgatgaccttgataagagcgaagatgatatgttaatggacgctttagatgctggagctgaagatatgaaggcaactgaagaaaagttccaaatcttcactgacccaagtagcatgacagatgttcgtgatgctcttcaagaacaaggctacgaattagatactgctgaagttaccatgatccctcaaaaccggacagaggtacctgcagataaggcaaagcaatatcgtcatttgattgatgaattaacagaaaacgatgatgttgctgatatttacgaaactggtattttaccagacgaagatgacgatgaagaataattcaatcattgttattaagaggttaaaaagcaaaacgctttttaacctctttttttagttttaaattttttagtgcatttttagaatttatccgtatttaaataatagggaggttaaaatatgccgagttttgaagaagaattaacaagaataattcgcaagcaaccgagtgacctgtacatcttacctcatgataggtattatcaattatccttagcgataaaggggaccctatttccttttaaacaggttacgcgtgattatggtcaacgttttatctcatacttaaaatattgcgccaatatggcagttagtgagcatcgacgaccccagctaggcgcttttaaatttacttatgctcaccaaaagatcaatttacgcttatcaagtgttggtgattatcaagggagggaatcattagttattcgctttatatatccccttaatgatattaggtttaattttttagttcctcaccagtgggaaatattacagaagtaccgtcaacaaagaggtttgattctttttgccgggccaatgggggctggtaaaacaactaccatgtatcagcttgctcgacagttattaccgaaacaaattgtattaacaattgaggatcccgtagaaattgaccatccgggatttattcaattgcaagtaaatgaattagcggggatggactatgaaagtttattaaaattgggattacggcatcgcccagatgtgtttatcattggagaaatccgtgattcacagacagctgctatgtcagttcaagccgcattaagtggtcacttagttttgggaactatccatgctcgaaatgcttatggcgttgtttctcgtcttcaacaattagggatagattcttattatcttcagcaagtattaacggcggtatcttatcagcgtttaattccgttggtgaatggagaacaagccatcttatgtgacctgttaaatcgacatcaatttagtgatttgctcaatggcaccaagaaaggaggaatgtctaatgaatggtcaaaagctcttcagcaggctgtggaaaatggagaaattacggagaatactgcacgtcaataccaacaaggttaaattcaatcatcagcaacaagcagattttttccttttattagcagatttgttaagtgttggcttttctgtcaaagaagcacttggttttatcaaggctgtcaatccgaagctagccccttggattgcttctatagataaacgaatgcaaaagggagcgagttttgcccagagcctacagcaagaagtaaaagacgatttgttttatcaattactattagcagaaaaacatggtaatttaacaaaaacattgagtgaagtaggaaagatacttacagcacgagaacggcaacgaaaaaaattatttagtctcctacaatatccgctaattcttttagggatgttaggggtggtaatttgtggattaattttgtttgtttttccagaattgaaagtctggcaaggcgagaggcaaactttgccgctgattcacatgattaagttaggagcaacttacctttttaccgttatcttcattagcgccgtatttcaatggctaagatggcatcaaatgaataaggaacaacggctaattaagatctgtacaatgccgataatcggtaaatgttattgttattattttcaatattatttaactagtatattaggatcaatgttgcaacaaggattgtcgttggctgaaatttgtgaaattacccagagttttgatagaaaatcaattctttatatttttggtaacaaaataatgactactattcaacgtgatggagatatttcagaagtggtggctacctactcttttctccctaatgaattaatcgtttttatgaataagggggcaaccagagaaaatatgggacgggacctaattgttttcgcaaatttaaaatttaaggcccttacaactgcaattgaacatttattgatttttgttcaaccagttatctttagcattattgcaatcataattgttattttatatcttagtatcttattgccaatttatcattcattccaaggagtttattaatgaaaattttaaagaaaaaacaatcaggcttcaccttgcttgaaatgtcaatcgtcttatttattattagcttactagtattgatcatgctgcccaatctctctcaacagcgaaagcatgctaatagtatccatggaaaagcgatgacatctgtaattcagactcaaattgatgcatacgaaaatgaaaatggaactgataatgtcagtttagaggaattgaataaagcaaattacctgactgatgcgcaagtccagcaggcccatcatgaaaaaattgtaattgttgatggaaaggcaattcagcgatgaatcttcaagaagaagggtttacgtttcttgaagcaatcattgttttagggatagcggccctccttttactaattacaattccaaattttacaaaaacgcgtcaaaaaatagctgaagaacaattttggcaatcattgcgtcaagattggcagtgggcgcaattaaagtgtgagagtaaacatcaatttattgtaattcgccacgacaaaaataacgaaatgattacttttcgcataaatgatcaaacaagagaaacaaaagaaattcttattccctcgacactgaatgttgagtggtttggtgaactttatcttacgccaaatggctatacgcgcccctgcacccagcgttttaaatcattaatcgatggtcactattactacatgaagattcaattaggatggggaggataccgagttgagaaacgctaaagcaaaagcatttatgatggcagatagtttaattagtttatttattgtagcgatggggataaatttattttttatttgtgaaaagcaattgtggttacaaaatagaaatcttcagctaaaaatggccgcaacaaggttaggaaaagaggctagtgatttatatgcggttaaaaagcaaccagttattttaagccgtggtgatttaaccgcaaaagcaacgatccaaagggtagttgtttataataacgatcgatgcctttatcgggttggaaaatgaagaagggggcctttactttagtagaagcaacttgcacattaattatttcttcattagtgattatcaatataagtttaattactactagcgtgagacaagtgggtaaaatgaatttagaatcaacgatcacttggcatttatttttacgggaattagaatcggccaatcatcgttttgaattaatggaggctcgtgatgatcggttattgctgtacagtcagacaactgatcaaaagtatgagttaagagaaaaccatgctctatacctaacgtgtcagaataaaggtggttatatgccattgttagataacattaagaatcatgaatactcgtttacgaaacttgattcccaacgagtattgattaaagtgacaaggaaggatggagagaaagcaagtgcaattgttaagttttatccaccaaaataaaaaagagggttctatcttatttgtaagtattgccgtcctacttataattagttcagttttattgtttcaatatcgatattatcaaaattatcaggaaatgggacgagacctttgttcaatttatattgataaaataaaagataatctaagaggtcaatgagagtgttatcttgaatttgctaggaataatagttaaactaataaggtaatgattgtattatttggaggcgactagcactgacacagaaaacaccacagcaattatttgagctttttgataaggccactgaaattttacaagcagcgttaaattgttcgtatttagatgcgctattagaaaacgcagaaaatattattgacaataatactgttcgtgttgatgacggtgttcctgacgaaaaaactgtaaatgaattgcagaaaatataccaagaattaaatttacaaaatgtgaagccagaaattatccggcaaattatccagctgagttttttgaaagtaattcgaaaagacgcaattcaggctaatcatcaaatgactcctgatacaattggcttaatcatggctttcttaattgaaaaggttacaaaaatcaaggagattaagactgtttttgatccagccgttgggacagctaatttattaacgactgttatgaatcagcttaaagtaaatggagataaagacatcgttggttacggaatagataatgacgaagatatgttggaagttgcgagcgtaagtacagaattacaacaccttaatgtaaagttgtaccatcaagatgctgtaactgctttggatattcctcaatgtgatttagctatttctgatttgccaattggttactatccgcttgatgaaaacgccaaaaactatcaaacacgggctaaagagggtcattcatatgtccaccatttgttgattgaacaatctatgaattatcttaagcccggtgcatttggggtattcttagtgcctagtagcttgttccaaactaaagaatcacaatcatttgttaaatggattcagtctgttgcttatttacaaggacttattaatttaccagcagaactttttgctaatccgaatgcgcaaaaatcaattttgttattgcagcgccagggcggagatagcaaacaagcagctaaagttttgctgggtgagtttccttcatttaaggataaagcaaaatttgcttcattcatggatgatgttagtaaatgggtaacaacgaatttacgttaaaggagaaaagtcaatgtcaaaaacaattgcagttaacgctggtagttcaacacttaaattcaaattatttgatatgccaagtgaagatgtagtagctgaaggtacgattgaacgtattggtgaaaagatgggtcatgctaagattaagtatggtaatggtcaaaagcatgaagaagataagccatttgctgatcatgctgccgcagttaattacttgttagacaagttaattgaattaaagattgtggcaagctatgatgaaatcacagcagtaggtcaccgaatcgttgccggtggagaattctttaaggattcaacaattattgatgatgatgttattagcaaaattgatgaattgtcagaatatgctccactccatgagcctgcagaattagttggtattaaagccttccgtaaagtattgcctaatgcatttgcggttgctgtttttgatacatcattccatgttgatatgccagaaatgaatgcattgtacagtgtgccttatgattggtatgagaagtatggtgctcgtaagtacggtgctcacggtaccagtcaccgttatgtatctgcacgtgctgcggaaatgttaggaaagccaattgaagagcttaaattaatcaccatgcatattggagcaggtgcgtcaatcactgccgtaaagaatggtaagtcattcgatacatcaatgggcttcacacctgttgcgggaataacaatggcaactcgttcaggggatgttgatccatccttaattgcttttatgcagggtaaactaaacttatcctcagatgagatgattgatattttgaaccataagtctggtttacttggtatttctggtatctcaccagatatgcgtgatattcttgcagctgctgaaaagggtgacgagcgagcacaacttgcattagatatttatgttaaccgcattgtccgttacattggagcatacattgcggagatgggtggcgctgatgccattgtcttcactgctggtgttggtgaaaacagtgttccagtacgaaagatgatcacagataagcttgactactttggtattaagattgatcaagaaaagaacaattgccatggtgttgaacgtgacctttccgccgatgatgcaaagattaagacattgttaattccaactaacgaagaattaatgattgttcgtgacattgaacgcttaaagaaaaataactaagcactaaataattcgtcaaaagatgactagttgacaagaaatgtttgtctctagtctctttttattttagaatttaagataactgtattgcctttttaagaaagaagattctctatgaagttttgcacatcagatacccatttttttcatgatagtctccttggtacaaatcaatttgcgccaaggccgttcaagaatgttaatgagatgaaccaaataattattgataattggaacgataaggttggtgaaaatgatattgtctatcatttaggagatattgctctgtactttactaaacctcaacgagatgcctatcaagcaattcttgaggtattattacagttacatgggcacttaatactggtaaaggggaatcatgataatcgcgccctttttaagtatctagaaaataataattatgagtttaatggacttcctaaatttcagtttcatgacgtgggggtactattaaaatataatcaccgtcaatattacttaactcattaccctcttatgttaggaatagcaccgcaaattattaaccttcatggccatattcaccattattcggtgccaattaaagaaaatataaacgtgggggtggatgctcctgaattagactatcttgaaaagaggcctaagtttggcgccccgctgaattttcatgaaatagaagaaatcgtgactaagaaaactataaagtacccgggacaaaaataattaaaagaaggtgggaaaagatgaatcgagctaagatccaagattatattgatcagcgtgaagagcagcgttctttaatctatcatattgaagaaaaagatcagacacattttaccattaatggacatccctacgaattagtaaaggattaccgtgatggttttaattcagaaaaattcgcagaacggtttagtagtgtcctaagtaaatatgactatatcgttggcgattggggatatgaccaattacgcttaaaaggtttttatgatgatgataatcccttatttgaaccagaattgggcactgatacgattgaagattatttatttgaatattgtaattttggctgtgcgtattttattgttcacaacgatgatgttagtattccacggcaacatggacacagtcatcgtcaacggcgaaagaaaactacgccaatcattcatgaacggcggcgacaagttaagcaaccgaacgtgcgtcaacggcaaaatcagcgtgcagaacgtgtaaaaaacggtcatcgtcaaaaatttgtgattcatcaacgaaaaaagaggagttaaggcaaacgatgaaagattatcaaggatactttattgatttagatgggactacttataaggggaaggaacggattccagcagccggaagatttatcaaacgactacaagaagcagggaaagaggttctatttgtaacaaacaacagtacccgaacaccagattttgtcgctgaaaacctccgtaaaaatcatgatattaatgttaccgcggaaaacgtatatacaacagcaatcgcaaccgctgactatttacggtcaatagcaccagcaaaaagcaagatttatgttattggtgagtcgggattaaagttagctttagaaaagcgtggttttatcttgactgatgatcaacctgaatatgtagttgtcggtttagatacgagtgttacttatgaaaaacttgaaaaagcagttttgttaattcgaagtggcgctaaatttatcggtactaatgctgatagtaatctgccaaatgagcgagggatggttccaggagcaggttcgattgtaaagttaatagaatatgcaacccaaacgaaacctgtgatgattggtaaaccagaagctataattatgaaaatggcacttgaaagagttcaattacctaaagagaaggtaattatggtcggcgataactatcacactgatattgaggcagcaattaatgtcgggatggatagtttgttagtatatactggtttatcgcgcccagaagaagttataaaagaaaaaattcagccaacgtataaggtgaataatcttgatgaatggaagatttgaatttattcaatggggaagagcaatattattgacgctacttagtttagttgttgcaattagtattgctctttttatcgttattaacatctcacctttttttataacaattcctaagcaccttttagggttatctgcggctgaattaatggctgattatggaaatgttattaaatatatccagcttccgacacagcgagtcttcaaactaagatatttaccaattgatccttctgcagttcaccattttaaagatgtaaagcgtttgattttattaaatgaagctgtgatgttggcttcaattccgttgttagtatgtggtttaaaaaaacaaaaacggcaaaatcagctctggcgcttgatcttaccgtttcagatgttatttattttgttgctctttagtggctttatgggaataacaaatttcaatgctttctttattaaattccattatcttttctttagcaatatggattggctatttgatccacgaacaacgccaatcatattactgatgcctgaaaaattttttacagtactatttggattatggttaggatttacattgataatcttacttttgatctggggatggataaagcttatgttacgcatcttctttaacaaagcgcgaacgtaatgctccgataactgctggaattaaagtaaccacaataattgcaagaatgattacagagaagtgttcttgaacgaacggaagattaccgaagaagtaaccacatccacagcaaagcgctacccatacaacacagccaattacactataacgaataaattgcttatatggaaaacctgaacctgccgccgcaaacggagcaaatgttctaataatcggaataaaacgggcaagaataatagccggtgcaccatgcttttcaaagaagacttcggcacgttctagactatctttatcaatcaatttaccaaaaagtgaatggttagaaagacttttaccaatcttatgaccaattaaaaagttaagggagtctccacccaaacaggcacataagaagatgaaaataaaaatccaaatattaagatgataacgagggtcagcagctagcgcacttgcagcaaagagaagggaatctccaggtagaaagggcattatgactgcaccagtttcgataaagataatagcaaataaaattaaataggtcgcatcaccgaattgattaacaatctgaattaaatgaatatcaatatgtagtataaaatcaataagagttgccaaagtaattctcctttgtgtaattaagctaatactgttaaagtgtagcaagatagaaaaatgttgtgaaggggcgtttaaaacttttaataatttttgaaaaatatatttattgtaagtataaattagttgtgtgagactagttcattcatagtcaatgacgaaaggatcattgcaccctctttgaaaaggctaaataacgtttattatcataatatggtaaagcaaacgaaaaaaatgaataaaaatcaaaaaaagtgttgacgagggaagaaaatccatgtatagtagttatcgttgtcaaagcagttaagtgctgctaagatggtttgacaaaaagttaaaaataattgttgacatccgcttgacgacgtgatatattaataaagttgctgattgagttatcaatcaaaaggaattcaaaattaattaaaatttcttcttgacaagctgatctgatacatgttataataagtatgctgattggccgcttgattagccaacaggtagacctttgaaaactgaacaaagtttcgacgaatcaaatgtgtagggtcttcaatcacgatgtgatttgaagcaaaacatttgcgaagtcaattcgcttaataacaaaataattgagagctattcaagttcttatatattttatatgagagtttgatcctggctcaggatgaacgccggcggtgtgcctaatacatgcaagtcgtacgcactggcccaactgattgatggtgcttgcacctgattgacgatggatcaccagtgagtggcggacgggtgagtaacacgtaggtaacctgccccggagcgggggataacatttggaaacagatgctaataccgcataacaacaaaagccacatggcttttgtttgaaagatggctttggctatcactctgggatggacctgcggtgcattagctagttggtaaggtaatggcttaccaaggcgatgatgcatagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaagctctgttgttggagaagaacgtgcgtgagagtaactgttcacgcagtgacggtatccaaccagaaagtcacggctaactacgtgccagcagccgcggtaatacgtaggtggcaagcgttatccggatttattgggcgtaaagcgagcgcaggcggttgcttaggtctgatgtgaaagccttcggcttaaccgaagaagtgcatcggaaaccgggcgacttgagtgcagaagaggacagtggaactccatgtgtagcggtggaatgcgtagatatatggaagaacaccagtggcgaaggcggctgtctggtctgcaactgacgctgaggctcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgctaaccttagagataaggcgttcccttcagggacgcaatgacaggtggtgcatggtcgtcgtcagctcgtgtcgtgagatgttgggttaagtcccgcaacgagcgcaacccttgttactagttgccagcattgagttgggcactctagtgagactgccggtgacaaaccggaggaaggtggggacgacgtcagatcatcatgccccttatgacctgggctacacacgtgctacaatggacggtacaacgagtcgcaaactcgcgagagtaagctaatctcttaaagccgttctcagttcggactgtaggctgcaactcgcctacacgaagtcggaatcgctagtaatcgcggatcagcatgccgcggtgaatacgttcccgggccttgtacacaccgcccgtcacaccatgggagtttgtaacgcccaaagtcggtggcctaacctttatggagggagccgcctaaggcgggacagatgactggggtgaagtcgtaacaaggtagccgtatcataacttaacctaaacaatcaaagattgtctgattaattgagttagcgattataattcgttaattaaaactcaaataacgcggtgttctcggtttattgttttgttaataaagaaattagatagtatttagttttcaaagtacaagctctgagggtaaacccctcaaaactaaacaaagtttcttcgatgtgtaggttccgttttattccttagaaaggaggtgatccagccgcaggttctcctataagggcgcatggtgaatgccttggtactaggagccgatgaaggacgggactaacaccgatatgcttcggggagcggtaagtacgctttgatccggagatttccgaatggggcaacccaatcagcttagtcgctgattacttgactagtgaatacatagctagcaagaggtagacgcagtgaactgaaacatcttagtagctgcaggaagagaaagaaacatcgattccctgagtagcggcgagcgaaaagggaagagcccaaaccaacaagcttgcttgttggggttgtaggactgaacattagagttaccaaagtgcgacgtagtcgcaacagttgggaagctgtgccatagagggtgaaagccccgtagacgaaacgtcacactctctgttcaggatcctgagtacggcgggacacgtgaaaccccgtcggaacccgcgaggaccatctcgcaaggctaaatactccctagtgaccgatagtgaaccagtaccgtgagggaaaggtgaaaagcaccccggaaggggagtgaaatagttcctgaaaccatgtgcctacaagctgtcggagcccgttaatgggtgacggcgtgcctcttgcagaatgaaccggcgagttacgattgcatgcaaggttaaggtggaaaaaccggagccgtagcgaaagcgagtcttaaatgggcgtaaaaagtatgtagttgtagacccgaaaccaggtgacctacccatgtccaggttgaaggtgcggtaaagcgcactggaggaccgaacccgtgtcagttgaaaatggctgggatgaggtgtgggtagcggtgaaattccaaacgaacttggagatagctggttctctccgaaatctctttagggggagccttgaggtaaagaatcgtggaggtagagctactgtttggacaaggggcccgtcatgggttaccaacttcagataaactccgaatgccatcgatttatactcaggagtcagacgatgagtgataagatccaccgtcgaaaggggaacagcccagatcaccagttaaggtccctaaatatatgctaagtggaaaaggatgtggagttgcatagacaactaggatgttggcttagaagcagccaccatttaaagagtgcgtaatagctcactagtcgagtgatcctgcgccgaaaatgtaccggggctaagcatattaccgaaactgtggatgtgcactatgtgcacgtgataggagagcgttctaagggcggcgaagtcagaccgtgaggactggtggagcgcttagaagtgagaatgccggtatgagtagcgaaagacaggtgagaatcctgtccaccgaatgactaaggtttcctggggaaggctcgtcctcccagggtaagtcgggacctaagccgaggccgagaggcgtaggcgatggataacaggttgagattcctgtaccagttaactgcgtttgacgatggagggacgcaggaggctaagcaaaccgtacgactggaagagtacggccaagcagtaagtcaggatgtgagtcaaatgtttacatccgtgttgacaagctgtgatggggagcgaaattaaagtagcgaagttgccgatgtcacactgccgagaaaagcttctaaggagtagttaactgcccgtaccgcaaaccgacacaggtagtcgaggagagaatcctaaggtgagcgagagaactctcgttaaggaactcggcaaaatgaccccgtaacttcgggagaaggggtgctggccgcaaggccagccgcagtgaataggcccaggcgactgtttatcaaaaacacaggtttctgcaaaatcgtaagatgaagtataggggctgacgcctgcccggtgctggaaggttaaaaggatgggttagcttcggcgaagctcagaattgaagccccagtaaacggcggccgtaactataacggtcctaaggtagcgaaattccttgtcgggtaagttccgacccgcacgaaaggcgtaacgatctgggcgctgtctcaacgagagactcggtgaaattgaaatccctgtgaagatgcagggtacccgcgacaggacggaaagaccccatggagctttactgtagcttgatattgagtgtttgtactgcttgtacaggataggtaggagccgtagaagtcgggacgctagtttcgacagaggcgctggtgggatactacccttgcaatatgaccactctaacccgcagcactgaacgtgctgggagacagtgtcaggtgggcagtttgactggggcggtcgcctcctaaaaggtaacggaggcgcccaaaggttcgctcagtatggttggaaatcatgcgcagagtgtaaaggcacaagcgagcttgactgcgagacagacaggtcgagcagggacgaaagtcgggcttagtgatccggtggttccgtatggaagggccatcgctcaacggataaaagctaccctggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgtaggaaatttgagaggacctgtccttagtacgagaggaccgggatggacataccgctggtgtaccagttgttccgccaggagcaccgctgggtagctatgtatggacgagataaacgctgaaagcatctaagtgtgaaactcgcctcgagatgagatttcccatttccttcgggaaagtaagacccctcagagatgatgaggtagataggatggaagtggaagtgccgtgaggcatggagcggaccattactaatcggtcgaggacttaaccaaggagcggtaaggtttattggaagagaatagataggatttagttttgagagcacaagctctcgtccgaaaggacaaagagtgtggtgatgatggcttgaaggatacacctgtacccatgccgaacacagaagttaagcttcaacacgccgaaagtagttgggggatcgctccctgcgaggataggacgttgccacgcttatggaggattagctcagttgggagagcatctgccttacaagcaggaggtcacaggttcgagccctgtatcctccattgagcgattaagctcatgagccgttagctcagttggtagagcatctgacttttaatcagagggtcgacggttcaagcccgtcacggctcattatcagatactatatctgataataaaaaataaagtgtcaattgccgacttagctcagttggcagagcacctgtcttgtaaacagggggtcggaggttcgaatcctctagtcggcactttcatatgcggaagtagttcagtggtagaacatcaccttgccatggtgggggtcgcgggttcgaatcccgtcttccgctttgccagttctataatgccggggtggcggaattggcagacgcacaggacttaaaatcctgcggttagtgataaccgtaccggttcgatcccggtcctcggcacttattatgcacccatagcgcaattggatagagtgtctgactacgaatcagaaggttgaaggttcgactccttctgggtgcatttttcgggaaatagctcagcttggtagagcacctggtttgggaccagggggtcgcaggttcgaatcctgttttcccgatttataaaattaatatattattagttttttcgcggtgtagctcagctggctagagcgtccggttcatacccgggaggtcgagggttcgatcccccccgccgcgattggctggctgttttggacctttagctcagttggttagagcaagcggctcataaccgcccggtcgtaggttcgagtcctacaaggtccatcagagattagctttgatgaatcattattgtttaatcttattaattcattatggaggattacccaagtggctgaagggggcggtcttgaaaaccgctaggccgtgagagcgacgcgagggttcgaatccctcatcctccttatattatcgcggggtagagcagtctggtagctcgtcgggctcataacccggaggtcgttggttcaaatccagcccccgcaattttggtccgttggtctagttggtttaggacgcatccctgtcacggatgagatcacgagttcgagtctcgtacggaccgtttatatttggctcggtagctcagttggtagagcaacggattgaagctccgtgtgtcggcggttcgattccgtcccgcgccattaacttaatattatgcgggtatagtttagtggtaaaaccacagccttccaagctgttgtcgcgagttcgattctcgttacccgcttttagatatgggcctatagctcagctggtttagagcgcacgcctgataagcgtgaggtcgatggttcaagtccatttaggcccattggagaagtactcaagtggctgaagaggcgcccctgctaagggtgtagatcgcgcaagcggtgcgagggttcgaatccctccttctccgtaatgacccgttagtcaagtggttaagacaccagcctttcacgctggtatcgtgggttcaaatcccgcacgggtcatctttattatcgcggggtagagcagcctggtagctcgtcgggctcataacccggaggtcgttggttcaaatccagcccccgcaattttggtccgttggtctagttggtttaggacgcatccctgtcacggatgagatcacgagttcgagtctcgtacggaccgtattaattagtgatagataaaaacttcctacgtataggtggggagtttttttattggccaaagtaaacagttgataaaaatggatatctgtcaactggtatggttgactaaaaatacttcctacgaaaatgtagggggtatttttttacgaaaaaatacaatcgattcttaaaaagaaaaatttttgattggcaaaaccataacaagttcgttttagagttttgattttgcgattgatgccttctaaaggaccattagagtattcaaacttagcactatttaagacatattttctgttttgacgaagggtttggatagcggtatccatttctgtattggttttttggtagtctaagatggttgactctagtaattcactattgcgctcgtttagggctttcgtgatatcttggtaagtttggtatacttcagcaaacttggaaaatttactagtaatgagatcaacagcattttggcgagtcatatattgcttaacgccgcgaagaaaaactacttcttcagggtgaagatcttcagcttttttatggaatagcttccaatgtgacttcataattttatattctcggctctgtttatcaagttgttttaggatagaaatacgacaattgtccaaagcgcgaccagctaattgcacaagatggaaacgatcaataataatgctggcattagggaaaaggcgatagataaagctttgatattgagcatttaaatcaatcacaactgattggacgcattcgcgttcggcttttgaataacgactttcaaaataatcaataatggtaggtgatagacgatcctgtaactttgtgacaatttggtgggtttcagcgtcacaacagataaaggacatcacagacttagttgaacgaaactcgtcaaaacatagatgcttaggcaacttagctacacgatagtgtggttccatgcgctctaaaattgttcgacgaacactgctaggagagcagtgacacatttcagcaattagctgaccagatagtcctttacgagctaaaagcatgatttgatttttgagattactggatagggtttgattttctttggttaaattagtaatagcaccaaacgtagtatggcacgatttacatttatagcgttgtttacgaagctctagttcatatcttctcccgtttaaactagccagtcgtacatgagttttgcgaaagccatccttattaactgtgggaaagccacagttacgacaacgattaatcggataagaaagagtagccgttattagtgttatatactctttaacagagtcatcgttgtgttcagcttcttcaacagaaataattttaatatttttatctttaattccaagaatatttaggatagaatcattatgggacatttgtttaaccttctttcatgatttttgtggtgaattgattgtataacgaggggacagcaaatgtctctttttttatacaaaaaaatctggcatggaatctccatccataccagaaagtgtatacccataaaaatacagatcaaaaaaacaggaccatgaattaccgaaaatgctaattcatggtcctgctgtaggtatcagttaaataccattggcaaatgcccttatgttattctacttattaaaaaatgggtttgtaaatttcatcatagtaactattgtctgaccccatactggtgaagttctttaaagatgtaaaggtttcgctttccttccatgcagttaaggcttcaaaatcagcccaagcagtcagtaaaactaaagtagtagcttccgctttattatcaacgctaagcatataaccaccattcatgtcagctggttcagttaataccttttgaagtgtattataaagtagcttttgacggtcaccgtttacttgaaatgattggtagtaaaacattccatttaattgagcatctagcgttgaatcaagagttgttaattttactggtgattgaaaaatagtatcttttccagaaaggtcaaataatgctaattttcttgtatgagtagttgcctgcattaatttaaaatgacgttcgggatatttatcaatgattgattgtaaaatttgtcgtgaaccaaatgttaagctaatttttgttaacatattaattcctcctcagaagttagtagtcatacttattatagtacaacttaatgtaaaataattaaattgtaaattttatctactttatttttgctaagacataaatggaaaatataatagtaagatagcttacaaaaagtcaataatttttgttatatcgctttaatattaattgaatagggagtataataaaaaatgtattaatgaatgttctagtttaacttaataaaggaggccactaaacgaaatggttacactatatacgtctccaagttgcacgtcttgtcgtaaagcacgtgcctggctaaaagaacatgatattgcttttaaggaacggaatattttttctgaaccattgtctttaaatgaaattaagaatattttacggatgactgaagatggtactgaagatattatttcaaagcggtctaaagcttaccaaaagttgagtgtagatcttaatgatttgtcaatgaaggctctgtttaagttaattagtaaaaatccaggattgttacgacgtccgattattattgatgataaacggcttcaagttggttacaatgaagacgaaatccgtcgcttcttacctcgaaaggttcgtgaacttgaactagtagaagctcaagaaaaagcaaatatgatttaactgatagaatatggaaagtgatatgctttcctttttttattcttttaaccgagtaactttacttttaagcgaaaatccttacaatagaagtaacatctagttttggtaaaaggaggtgctgctcaatggagatggaacgcattaatgaaaatactattcgcgttttggtagataatgatgatttatctgctcggggtatcactattctagacttacttggcgatcatcagcaaattgaggatttcttttatagtatcctaaaagaagtagatactgatcaccaattccaaaacaacgatgcggttacttttcaggtgatgcccactaataatggcttagaattatttattagtaaaaatgattctaattttgctgggaatgaacagcatggaccaattaatgaccaggtgtccaaatatattaagcaacatttgattcaaaaaaatagtccggatcaagatcaaagaaaaacagcgattaatgattcagaggataatgagattcaacatactaactggcaagtaattacatttgattcttttgaagatttgattgattttgcgaaaattgctgagagtgatgatgtttcatcatatttatataagtacaatgatttgtattatttagcaattgcttattctgattctattttgaacagtaatgatgttaaagatcaacttgctcttgcttatgaatatggaaaccccacggcaacaacggttgattttctaagtgaacatggaaagaaaataatgtcagtatctgccttgcatttaattcgacactattttgaataagctgcgtttgagttcatactcaacgtagctttttttcgtgcaaaattgattaatttccgtatataaatatatagggggattaaatgttaattgcagttcataacgatcaattagtgttggctggaaacgccaaaagcgatatggcatattattgtccaggatgcgggcagggagtgatcttgcgacgaggaaagcataagattactcattatgcccataagaagggaaatgactgtggctttagcgagggtgaaacgttagaacatttaaaaggaaaaaaacagatctatcaatgggcacaaaagcatcattggaatccgcaattagaagtttattttccaacaattgctcaacggccagatattcttttagaaattaatgggcatactgtagcagttgaatttcaatgtagtcccttaagccttgaaaagttattagcacgtaatgaagggtatcgccagttaagaattccggtttggtggatattaggatcaccttatttgcgtaacttgaggaataaaaaaatcgtgcagtttacgcaaatttttagaaaacagtttgttctcttattttgggatgtgaaaagggcgcaattagttattaatcagaaatactggcgttgctcctatagccggttaaagtatgataaaaagactattttaatggagcagattgaaatgttggagaagaaacagtatcattttccaagtaaagaaataagagaactatcattaactactttaagacttactggtcacgctttatcagaatgtccgttggtatgccatgatcttattgcaagttggccggcaatgtctattccaataattatttggcgaattggtgtaatattagagatagagaaattccctttattttattcttggggggataaggaatggaaaaacttattaatgaaggtaaataaaagcgactggctattccccggttgtttacctccagaaacgattcgcaatattattatcaaccaatatacaaacgaattaattgcctttaaagtaatttatagggaggataatcatcttattttaattcatcgtccacaatggtttaatgatgcacagttaaaactacagctggttaaaaggagatcataatatgcaacatacatgtacaatgtttttagcaggaaagaatgcaacgattgatgggtcaactatagtttgtcgtgaggaagattatggtaatgcatttaatcctcaaagatttgtattagtaaaaccagaaagacagccacgtcaatatcaaagcaaaacaactgactttaaaattgatttaccagttcctaagctaaaatatacttctacgccagatgctgacgataaagatggaatttttggtgcaggcggtatcaatggtgtaaatgttgcgatgagtgcgactgaaactattactactaatgcccggatattagcaatagatccttataacactttatctggaattggcgaagaagattttgtaacattagtccttccttatattaagagtgctcaagatggtgttaagaaactaggaagtttattagaaaagtatggtacttatgaggctaatgcgatagcttttagtgataataatgaagtgtggtatatggaaacgattggcggtcatcattgggcagctgttaaaattcctgatagtgcctatgtgattgctcctaatcgatttaacattactaattttgattttgacggtcccaacacaatgagttcaccaaatttgaaacagtggattgatcaaaataagttaaatcctagcgagaatgaatacaatttacgacgtatttgtggaagtgcaactgctactgatactgtctacaacaacccacgagcatggtatgttcagcagcaattagggacgataaatgctaatccgcaaagtaataaccttccattcatctgttatgcaaaagaaaagcttactgtaactacaatcaagaagttaatgagttctcattatcaagggacagcttttgatccatatcatttagaaagagataaagcaccatttaggtcaattgcattaaaccgaaacttagaattacatattttacaaatacgtaataatgttcctgcaagtattgctggtgtccattggttggcatttggccctaatacttttaatgctgtggttcccttttatgcaaatattgacgataccccaatcccttatcgaaacactagtactgaatattcaatagacgatatgtattggctcactcatacaattgctgcgcttggggaccaaaattatcggcaagcacagagtattgaagaaaactttgaattgcaagtaatggcaaaaacaatgaatgttcaaaagaatacggataaggaaatagcagaacaccaggatgtgagtgcatttttaaccacaattaataatcggatggccgaaaccgcagtggacgaaagcaaaaaattactagggaaactagtaaagcttactttttcaagagaacgattacaattctaggcagaaaataaaaaaagaggttggatagatggtgcaataatgaaagaccaacttttccaatctcttttttattaattattattttgtataatttgtagctttggtggacgatattggttcacaaattcatctaaggatgcagatcgagccaattttcggcttttaaatgcgtttattaaagtattatagtcaaaatttggaatcattaggccgtaatcagaatcttcggtgttaaaaacgactgcggtagccgtttctgatacgcctagattacttgcgattttttgatcttgacggaaagcctgcttagcaagttgactttgccgatcctcaaaaaacatttctaagtcaaggtgtgaatcatgtgcaattttattaattaatccatcgttgtaatccaagccttggttaatcagcgcagattgtaattgtaagagataatgccgtccacgttttcgtccttggaagagggctgctttataatctaatattacttgattaagggtttttgatacttgttgtcttgcagcaagatcatggggattaagatgataatatttaagtgtgctatcgatcgttttcatattgaatagtggtacaaattggtaactaatttttgtatttaaatcacgatcaatttttaacacgtctttttcacaccgtaaacagcgcattcctaatggattcacaaaaagatgaagttcgagcataattaacccctccgatcatttgtatactcaaaatcctaatcctgtgaacataattatttttgcaaatatctaactatttgtaaagaatttagttttaagataattacaagagttattattataaatgtgctaaaatatacggagatttaacaggaggctgaattatgattgaagattggcagcattttttattgccatatcagcaggccgtaaatgaactaaaagtcaaattacgggggatgcgaaagcaatttcaagaccaaacgcaacattctccgattgaatttgtaactggacgagtaaagccagttgatagtattaaagaaaaaatgattagacgacatgtgcaagaggaccgccttgagcaagatatgcaagatattgccggtttgcggatcatgtgtcaatttgtagaagacatttataaggtagttgacttattacggcagcgaagtgatatgactattttagaggaacgtgattatatcaccaacgttaaaccaagtggatatcgttcctatcatattgttattgaatatccggtccaattgattactggagaaaaaagaatattagctgaaattcaggtgcgaacccttgcgatgaacttttgggcaacggtagaacattctttaaattataaatatcaaggtgagtttcctgaggagctatctgcaaggttgcaaagagccgcagaggcagcgtttaagcttgataatgaaatgtcagagattcgagaagaaataaaggaagcacagacattattttctaagcggaggtcaactaattctattaatgaagatgagttaaaggagtaagttatgagaattggaatatataataatgaaacagcagaatctcaacgagtgacaaaggttttaaaaaccgaaatgaaacgagcaggtttaacttatgtcgaaaaaaatccagaagttgtaataacaattggtggtgatggcactttgttatcagcttttcatcattatcaaaaagatttaaataacattcgctttgttggaattcatactgggcacttaggattttatacggattggcggagttttgaaattgatgatttagttgatagtttagtaaaagatagcggacaggcagtttcatatcccttacttgatatgaaggctacttattctgatgggcagatagagaattatattgcacttaatgaatcaacaattcggaatgttacacgaacaatggtatgtgatgtgtttattaataatcatctgtttgaaaactttcggggggatggtttatgtatttcaactccaaccggttcaactgcttataataaatcagtcggtggtgccattgtcgatccaaatagtgttggctttcagttagcagaaatggcttcacttaacaaccgggtttttcggaccctaggctcaccgattatttttggtgctgatgctgagttaattttgcgtttgcgtgatgaaaatggtcatgtgcttacatgcgaccgtgatcaatggatgcttaaaagcgagaaagaacggtatctgactgaattatcttataaagtatccaagcaacgaatatattttgctcaatatcggcataataatttctggaatcgagtaaaagattcatttattggtggagtgcattaatgaaatttaattggatatacgatcatcgcacaccacggaaattacgatcggcattaaaaatgtatggggtttcttcttcgttattaaaagtagccatataccatggaggaaaaatgcaaataaacggggtagataagtgggccgttgatactgttaattaccttgataaggtaacattaatcctccctccagaaactgctaatgataatgtggatgtcagtgaggcacctatcgatattatttatgaagaccaggattttttaataatgaataagccggcaggagtagcaacagttccggctcataatgttccggtagccgatagtttggtgaatcgggtaaaaggctactataagcgccaaaattatgaaaatcaggttacccatgttgcgacacgtttagaccgtgacaccagcggcttagttgtttttcctaaacaccgatttgctcacgctgtcctcgatgaacagttaaaaaaacatttagttaagaaaaactatcttgctctaattaaaggaaaagttcctgcagagcatggttatattgatgcgccgattcaacgcgatcccaattcatttgtaaaaagaatggtagggaaagaggggaaagcatctgtaactgaatactggcgccaagaatgtaatgttcaagcaagcctcatcaaaattaggttgcatacaggtcggacacaccaaattcgcgttcattttgctagtcttggttttccattaattggcgataaaatgtatggtgaagaatcaggattaattgctagacaagcgctccattgttattggctaagcttttatagtccatttaaaggtaaaaatattactgtttcggcaccattgccaagtgatttcaaaaacgctaaagatgatcttttaagtacaaaaaattattagtaattgaactaattaatagaaaattgccaggagataaaattaatttgcttactggtaatttttttataaaaaagtattgcaaataataaaaatatagggtagaatataattcctgtcatcgataaggcatgagtaaatgatcatatctattaagattattaagagtaaatatggttgtaaagtcaatgatttttgaaatattttataaaaactgttgacatctacttgatgacatgatatattaataaagttgctgattgagttatcaatcaaaagggattcaaaattaattaaaatttcttcttgacaagccgatctgatacatgttataataaatatgctgattggatgcttgattagccaacaggtagacctttgaaaactgaacaaagtttcgacgaatcaaatgtgtagggtcttcaatcacgatgtgatttgaagcaaaacatttgcgaagtcaattcgcttaataacaaagataattgagagctattcaagttcttatatattttatatgagagtttgatcctggctcaggatgaacgccggcggtgtgcctaatacatgcaagtcgtacgcactggcccaactgattgatggtgcttgcacctgattgacgatggatcaccagtgagtggcggacgggtgagtaacacgtaggtaacctgccccggagcgggggataacatttggaaacagatgctaataccgcataacaacaaaagccacatggcttttgtttgaaagatggctttggctatcactctgggatggacctgcggtgcattagctagttggtaaggtaatggcttaccaaggcgatgatgcatagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaagctctgttgttggagaagaacgtgcgtgagagtaactgttcacgcagtgacggtatccaaccagaaagtcacggctaactacgtgccagcagccgcggtaatacgtaggtggcaagcgttatccggatttattgggcgtaaagcgagcgcaggcggttgcttaggtctgatgtgaaagccttcggcttaaccgaagaagtgcatcggaaaccgggcgacttgagtgcagaagaggacagtggaactccatgtgtagcggtggaatgcgtagatatatggaagaacaccagtggcgaaggcggctgtctggtctgcaactgacgctgaggctcgaaagcatgggtagcgaacaggattagataccctggtagtccatgccgtaaacgatgagtgctaggtgttggagggtttccgcccttcagtgccggagctaacgcattaagcactccgcctggggagtacgaccgcaaggttgaaactcaaaggaattgacgggggcccgcacaagcggtggagcatgtggtttaattcgaagctacgcgaagaaccttaccaggtcttgacatcttgcgctaaccttagagataaggcgttcccttcagggacgcaatgacaggtggtgcatggtcgtcgtcagctcgtgtcgtgagatgttgggttaagtcccgcaacgagcgcaacccttgttactagttgccagcattgagttgggcactctagtgagactgccggtgacaaaccggaggaaggtggggacgacgtcagatcatcatgccccttatgacctgggctacacacgtgctacaatggacggtacaacgagtcgcaaactcgcgagagtaagctaatctcttaaagccgttctcagttcggactgtaggctgcaactcgcctacacgaagtcggaatcgctagtaatcgcggatcagcatgccgcggtgaatacgttcccgggccttgtacacaccgcccgtcacaccatgggagtttgtaacgcccaaagtcggtggcctaacctttatggagggagccgcctaaggcgggacagatgactggggtgaagtcgtaacaaggtagccgtatcataacttaacctaaacaatcaaagattgtctgattaattgagttagcgattataattcgttaattaaaactcaaataacgcggtgttctcggtttattgttttgttaataaagaaattagatagtatttagttttcaaagtacaagctctgagggtaaacccctcaaaactaaacaaagtttcttcgatgtgtaggttccgttttattccttagaaaggaggtgatccagccgcaggttctcctataagggcgcatggtgaatgccttggtactaggagccgatgaaggacgggactaacaccgatatgcttcggggagcggtaagtacgctttgatccggagatttccgaatggggcaacccaatcagcttagtcgctgattacttgactagtgaatacatagctagcaagaggtagacgcagtgaactgaaacatcttagtagctgcaggaagagaaagaaacatcgattccctgagtagcggcgagcgaaaagggaagagcccaaaccaacaagcttgcttgttggggttgtaggactgaacattagagttaccaaagtgcgacgtagtcgcaacagttgggaagctgtgccatagagggtgaaagccccgtagacgaaacgtcacactctctgttcaggatcctgagtacggcgggacacgtgaaaccccgtcggaacccgcgaggaccatctcgcaaggctaaatactccctagtgaccgatagtgaaccagtaccgtgagggaaaggtgaaaagcaccccggaaggggagtgaaatagttcctgaaaccatgtgcctacaagctgtcggagcccgttaatgggtgacggcgtgcctcttgcagaatgaaccggcgagttacgattgcatgcaaggttaaggtggaaaaaccggagccgtagcgaaagcgagtcttaaatgggcgtaaaaagtatgtagttgtagacccgaaaccaggtgacctacccatgtccaggttgaaggtgcggtaaagcgcactggaggaccgaacccgtgtcagttgaaaatggctgggatgaggtgtgggtagcggtgaaattccaaacgaacttggagatagctggttctctccgaaatctctttagggggagccttgaggtaaagaatcgtggaggtagagctactgtttggacaaggggcccgtcatgggttaccaacttcagataaactccgaatgccatcgatttatactcaggagtcagacgatgagtgataagatccaccgtcgaaaggggaacagcccagatcaccagttaaggtccctaaatatatgctaagtggaaaaggatgtggagttgcatagacaactaggatgttggcttagaagcagccaccatttaaagagtgcgtaatagctcactagtcgagtgatcctgcgccgaaaatgtaccggggctaagcatattaccgaaactgtggatgtgcactatgtgcacgtgataggagagcgttctaagggcggcgaagtcagaccgtgaggactggtggagcgcttagaagtgagaatgccggtatgagtagcgaaagacaggtgagaatcctgtccaccgaatgactaaggtttcctggggaaggctcgtcctcccagggtaagtcgggacctaagccgaggccgagaggcgtaggcgatggataacaggttgagattcctgtaccagttaactgcgtttgacgatggagggacgcaggaggctaagcaaaccgtacgactggaagagtacggccaagcagtaagtcaggatgtgagtcaaatgtttacatccgtgttgacaagctgtgatggggagcgaaattaaagtagcgaagttgccgatgtcacactgccgagaaaagcttctaaggagtagttaactgcccgtaccgcaaaccgacacaggtagtcgaggagagaatcctaaggtgagcgagagaactctcgttaaggaactcggcaaaatgaccccgtaacttcgggagaaggggtgctggccgcaaggccagccgcagtgaataggcccaggcgactgtttatcaaaaacacaggtttctgcaaaatcgtaagatgaagtataggggctgacgcctgcccggtgctggaaggttaaaaggatgggttagcttcggcgaagctcagaattgaagccccagtaaacggcggccgtaactataacggtcctaaggtagcgaaattccttgtcgggtaagttccgacccgcacgaaaggcgtaacgatctgggcgctgtctcaacgagagactcggtgaaattgaaatccctgtgaagatacagggtacccgcgacaggacggaaagaccccatggagctttactgtagcttgatattgagtgtttgtactgcttgtacaggataggtaggagccgtagaagtcgggacgctagtttcgacagaggcgctggtgggatactacccttgcaatatgaccactctaacccgcagcactgaacgtgctgggagacagtgtcaggtgggcagtttgactggggcggtcgcctcctaaaaggtaacggaggcgcccaaaggttcgctcagtatggttggaaatcatgcgcagagtgtaaaggcacaagcgagcttgactgcgagacagacaggtcgagcagggacgaaagtcgggcttagtgatccggtggttccgtatggaagggccatcgctcaacggataaaagctaccctggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgtaggaaatttgagaggacctgtccttagtacgagaggaccgggatggacataccgctggtgtaccagttgttccgccaggagcaccgctgggtagctatgtatggacgagataaacgctgaaagcatctaagtgtgaaactcgcctcgagatgagatttcccatttccttcgggaaagtaagacccctcagagatgatgaggtagataggatggaagtggaagtgccgtgaggcatggagcggaccattactaatcggtcgaggacttaaccaaggagcggtaaggtttattggaagagaatagataggatttagttttgagagcacaagctctcgtccgaaaggacaaagagtgtggtgatgatggcttgaaggatacacctgtacccatgccgaacacagaagttaagcttcaacacgccgaaagtagttgggggatcgctccctgcgaggataggacgttgccacgctacagcaaaaggacatgcattgtttaatacagtgcatgtcctttttttagtgcgcccggcatggatattaactatgcgttgaaaggcggatacctggtgtaagcagtgtaagcagtcaataacagtacggattgaaaaaattgggatcatgagctaccgaaaatggtaattcatgaccccgttttatttatggcattctgcttgaatttcttttgaccatggcaaataagcctcaagtcctgcgtccttgcggtttggtaagtgatcaaaaagatacttaaagtatttgtagatatttaaatggttctggtttgcagttgccaccaaagtatagaaaatggcatttgcctgagctccagcagagcttttcgcaaataagctattctttcgaataagagttgatggacgaatcgcttgttcaaccggattattcgttaacggcactcgaccatcttcaaatatttgatatactcgctttcttagtttcaaagcattattaatggcagctttcaaccgtccttgaggaaaactgatattttctaaataagtatataacttatccatcaaaggcttcacgtgcaaccgacgttgcactagtttttccttatgattggaatatgttaattgtttctcttcatgaaagatcggtcgcattagctgtaaaactcggtatgctttggagttcttcaattgctccttattcaataaacatgtaatgtgataaaattcacgtcgaatatgaactaaacatgacccaaattttgcctggggatataatcgatcactatatccaccataaccgtcacacataataattccacgatattgatgaccgataatttgaccaatggttttacccgcgcgggtattatagtaatgaaacatgataatttgatgcttactgaattcttttgttgatcgcgttacccaaaagtagccagtttcattaggctcatcaattaccttgaatggagtttcatccatatgaattaccgattcttttctgattaattcctgtaaataatcatacaacggttcaaggtaggtttgactaaccttaatgatgttagtcgccaataatcgagcatcaactcgtaagccgacggcttgccaaaacttaatttgacgatgaaacggtaaagcaagattaaacttcaactctgctacttatagtactcgaaaagtaactatggggtaaaagactctgtggcatcttactactgacaagtacatcgctaccattagaattaatacactcattacatttataagtttcttgaatcaaattcacacaatataattcagctggttttaaccgtgcttctctactatatacatgttgacccacttttttcattagttgatgacagtgtgggcagttagtatcttttaatggaataacttcttcaacctgtggtaaaccatctaaaaaagtggtccgctgaccagattgttttgctttccggtgacgcaccacttgctttattttcttttcagtcacttccgtgactgaaatatcaggatcttgaagttgatccatttcttgctcactaaataaggattgttgtccatcaacgacgggctccattacttcagtttttttccaaaatatttggttcttttgaagtttgataatagctgttaattgagcaatcttttcattggccatagctaattgctgtttaagttctttgatttgttcttccgctgtttgcttcatggtacgtcacctcctttgaattattctttggtaattatatcaaagaattcttcttttaaatagaggtaactcaataaaaacttcccggtcgaacagcttgaattttacgaattggtaatgggttcagtccttgcaataaccagtcgagctgttgagcagataattctttggcttcattactgtttctcggccaactaaggtggccattttcaaaccgtttatagagcataataaagccctcgccatcccaaaacaatcctttaaagcgatcattacgtccgccgcaaaataagaaaagcgaattattatataattctaatccatagttctcagcgattaccattgcgagcccatcaataccttttcgcatgtctgtttttccacagactaaatagatatgatctgggtcatgccaattaacgagcataacgaataaccactttaacgatatccgaagctaaaacagaattagtccccttgaaaatcgttaattcgacttcattcacattaatttttacggcagggcgtgccgtaaaagaatgcttttgtaaattacttggcctgtttttgaaaactggggtaataatttcattttgttctgtcataaataaaaaatctccttactgatgatagtctcagtatagaagatccggggtagctagagctagacgtactgttattgactgcttacgatctaatctcagccttgcggccgatatagctaaagtggtaattcgctatgctcattaattggcacgcaccggagcacgtttaccttatttgtggtaagacagacctcttctagaaccacaaacgttatcaagaaaaattaggcagcttaacaccggtacaataccggcattaagctgcctaagaaactttgtataatttattgcctaattgacagacagggcccagttcattttaccgaacgttgaaggtcattgttgtttcagaggttaacttcgcggcgaaaaacaaaattataagtaatttctatcttgctctcgctgttgatatttagcttatttccacttcattacacacactggttctggacaactaacatctttttgaagaagagttaacttaccagttgatggatttcgtttataaagcgtaaggttatcagagttctgatttgaagctaaaagataattttcatcttgatttagattgaaatcgcgtggaaaatctccttcagttgaaattgattgaatatgtttaacggtaaaatctggttggacttcaaagacggcaatggtgttttcaccacgatttgaagtatagacaaatttaccatcatttgagatccggatagcagctgctccattgtgagctgtccagtcttcaggaattgttttgagcgtttgaaggtgcttaaatgatgcatcgttactattatacttgagtacttctagtttactgcttagttcacctaaaagataagcataattaccatttggatggaaagctatatgacgggtaccaaagccatcttcacacttgtagcgagagacagcagttaatttaccatcatcagagacatcgtaaaccacaacaagatccattcctaagtcacatacaactagacgattgtcaggagttagatcggcataatgaacatgtggagcctcttgttcaggttcaggaccagttgctccttcatgaaggacagaatcagtttgtgtcaacgttccatcttcgttgatcttaaaaacatctatttttgctgtatgataattagcgctgaataataaatgccgtttgttatcaacgccaacatatgcaggaggggcaccggcagctaaaacatcgcttaacatcttagcattgtcgtcgcttaatgaataagaggcaactcctcccttatcatctacttgtttaattgcgtagatccgatcatcttgaccaacttgtaagtaagctggcttttgagatggaattgctagttcaacattcgttattttttcttgggcagtatcgagggtaactttatagatccctttacttgcttttttagtataagttccaattagaaattgttcaatcaaggcaatttcctcctttttgaaaatgcttacctatataatagcaatttgctcatcgtaattctagctgtgatacactgttattagtaatttttagttgttaatggaggagaaaagttgaaaaaagttgaacgtcaacgagaaatggtaaaaaataatcttgccctttttcaatgtcctgtttgtgaacagccaatggagagaatcgaaggaaacagtattatttgtggaaatagtcatcgctttgactttaatcggcatggttatcttcactttcttaatggagcggctaatactgaatatgatcgctcaatgtttgaatctcgtcgtcagctattaaatgcaggactatttaagccaattattgaaaatatcggtaaattcttgccttcaaaatctttaaggatcttagatgtagggactggggaaggaacaccattattacaattagaaacaatccgtgctaattgtaatgatacgatgattggctttgatatttcgaaaccagggataacgcttgctactcagttaccgttaaaggcatttttttgtgtagctgatttacgtaaattaccttttaatgatgagagttttgattgtatattagagttgttttctccatctgattatcaagagtttaaacgggttctaacaaaagatgggacccttattaaggtaattcctaacgctaactacttagtcgaattacgtcacctcttatatgaaacaggagaacgtaattaccactatgataattcacgagtaatcgagttatttaaacaacattatcctcatagtaaagttgaaacagtaacctaccaatttagaattccagatggcttacaacaagcgatgctggaaatgacgcctttacactggggagcaaacgctaaaagattatctaaagaagaattaacccaattaaaaacaattacggtggatgtaagcttattaattgcgaaaaaagctaattaattattgcaacattactaaattagtgctaaattattataagaaatcgtttgataattgacatcgaatataagtgtttcgttggtaattatcaaggagtacttcattaaagcagcgtttcgccgtgcccacaccgagaccctgctttttttattttattaaggagattttattatgacaaaccatattgtcttgtttgaaccattatttccagcgaatacgggaaatattgcacgaacttgtgcggggacaaatactgaattacatttaatcaagccattaggattttcaactgatgataagcatatgaaacgggctggattagactactgggataaagtaaagatcacgtatcatgaggatttaccttcatttatgaaaactattcctgatattaaccgtttatatattgtttctaagtttgctacccatgattatagtgatgttgattatacgggtgaaggagatcattatttcctatttggaaaagaaacaactggcttgcccgaacgttttatgcaaaaatatccagaaaatgctatccggattcctcaaaatgacaataatattcgggccctaaatttatcaaacagtgcagcgattgttatttatgaggcattgcggcaacagaattttcctaatttagcacgcgttcataaatatgaatttgataaattaaagtaaccttaaggaggcaataatgcgatggcgagaagaaaaaaggcatcatcccgccggacaagagggaaaaaacaacagtatcgattaatggataatctattaggaataattgtttgccttttaatgttagttggcttatttaatttaggagtattaggaacctttctcgataactgttttaagatttttgtagggtcatcctttccgattgcgatgattattgtttttctttatggattatgttttgcattgtatgggcatcgtccgcatttcaaaaaacgttggattgcaggaactattattgcctatattggtttattaatgtggcttcagacagtaatgtttcagcgtctgaatcttcatgcaaaggtaatcgaaactacttggaatagtcttagtaaggtcatttttaatggtgattcgactgttccggttggtggagggatgattggtgcttacctatataatggaagtaatattttaatttcagaggttggaacagcggtattatcatggttattaatgattatcggaattattgtcttttttgcattaccgtggcgcgaatttctagtaaaatgtgggattggcattaaaaaatctggagcagcaatggctaatgctcacgatcaattaatgaaaaagagaacggagagagcaaccaagacaactacggtaccatcaattagcgtgccccttgctaaagcatcaaggcaggttaaagatttttttgctgaccaagaatcagcagagccaacgtcaacgccgccggtttctccagcgatgcctattcaagatcctgttgaaccaactattagggtcgcaagtgaaagtcaagtggaaggaactcatagcggtacccaagatgagcagacttcgaaacaacatgacgatacggaaattaaacttgcaggaattgatgctaaagaagataatgattatcaattgccgccagtcagcctgctaagtcaagtaaaagcaacagatcagcaggaagatttgaataatatcaaaaagaacaccaaaacacttcagcaaaccctaaaatcttttggtgtggatgcaacagttgaaaatgttaatttgggtccttccgttaccaagtatgagttacgcccagcagtaggagtaaaagtcagccgaataacccatttggctgatgatttagcccttgcccttgcggctaaagatatccggattgaagcgccaatcccggggaaatcattaattgggattgaagttccgaaccagcaaattgcaacagttggttttcgcgatatggtcgaaaatgctcctagtaatgataatccaatggaagttccgctgggtcgcagtgtaactggggatatcaaaatggccgatctaactaagatgccacaccttcttatcgctggggcaacgggtagtggtaagtctgttgcaatcaacgttatcattacaagcattttattaaaagctaaaccgcatcaagtaaaaatgttaatgattgatcctaaaaaagtcgaattaagtgtttataatggtattccccatctgctcagtccggtagtttctgaacccaaaaaggcagctcgggcattaggaaaagttgttgcagaaatggagcgccgttatgaattgtttgcaaaattcggtgttcgtaacctggatgggtataataagttggtcaaacaacaaaatgatgaccatcctgatgaagttcaagctaacctaccattaattttagttattgttgatgaattagccgacttaatgatgactgtttctcatgatgttgaagatgcaattgtccgaattgcacaaatggggcgggctgctggtattcatatgattttggcaactcagcgtccttctgtcgatgttattacagggcttattaaggctaacgttccttctcgaattgcctttgcggtttctagtggggttgattcgcgaactattatcgatactaatggggcagaaaagctccttggtcgaggtgatatgttatttgaaccaattgatcaaaataagccagtccggattcaaggcgcatttatttctgatcatgatgttgaatcagtagtagactttataaaaaacgagcgagcggctgagtatgacgataatatggttgtaactgataatgaaatcgagcaagaagaacaagctgaggaggaagatgaattgttccccgaagcattagattttgtggttgatcaacaaaaggcatcaacttcgctaattcagcgtcgttttagaattggctataatcgtgcagcaagaattattgatgatatggaacagcgtggatttatcggaccagctaatggatcgaaaccacgtgaagtttataagcaaaaaagtgaggaataaaaaagaccggagagatttttctccgatcttttttattccgactacatggatgtttaataggctaaattaagtttaaggatgcaactgctccaaaaattaaagaaccaagcattgcaattaacatgagccaaatagcaaccatggtaattttttggaaacgagttttcttttttcgctgcattattaaccatccttccatttttatcaataatagtagtgtaacgcatctttaatgcctttttcaaatctagttttagtttatgttaaacttaaattacttatttgaagagaaggggactgaaaaggttgatggttagtattcaagttataattttagagattattttattattagtgattgggatagtagaacgattattagtacgaatatttcatcatcctaaaaaaacaaagcatttatggtggggatggacaattattttatggattctgataatctttaatattggattttattggccagcttatcctattgccttatggatgattctagctctgttattaattgctttacaaattattcacaatcatgaattcatttatcgccgttactggccagtattttggcggtattcggcatattatgctttaactatatatattggtagcttaattatttcaccatggttaccgttgatataaaaatattaagtgaattgaggctgggagaaaacaaagttttctctcagcctcaactgttttcacgaacaatatcaagataacgtggaaaataatcacaaggctcgagtctaagtacgaacgctaatcagcgttctagcttagttcaacgccttgtcgaggagattatttcccacttccgctcacttttttgtgtctattactttttggtaaaattcacaaaattacgtggtgagaagtgggggattgtggtagacttgacctataacgtggtaaaggaggacattagtcgtgttaatgggagaatttacacacactattgattccaaaggccgactaattattcctgccaaatttcgagaacaattgggggcacacttcattgttactcgggggttagatggatgtttgtttggatatccattaaatgaatgggcgattttagagcaaaagctaaaggcgctcccattaacaaagcgtgatgcacgtgcatttgtacgctttttatattccgctgcgacagattgcgaaattgataaacaaggacggattaatattccgataacattacgaactcatgcttcacttgaaaagaagtgtgtaatcgttggtgtgtctaatcgtttagaaatctggagcgctgaacggtggaataaatttacaagcgaaacagctgataattttgatgagattgctgaagatcttaatattgatttttaatggaggttttagttgatggcagaatttaaacatgtaacggtacttttaaaggaggccgtagcaggattaaatgtgcaaccaacaggtacctacgttgatgcaacattaggtggtggtggtcatacgcaagctattttacaacagctcgtcgatggccacctatattcatttgatcaagatcagacggcaattgattacaataaagaacacttgaaaactgcaatagaacagcaaaaattaacattagttgaagataatttccgcaacttaaaagcggaattgaatagctataatgtaaaacatgttaatggaattttatatgatttaggtgtttcatctccacagttcgatgatgctaaaagaggttttagctatcagcatgacgcacccttagacatgcggatgaatcaggaacaaaaattgtcggcaatggaagttgttaacgaatggccatatgaacgtctcgttaagattctttaccgatatggagaagaaaagtttgctaagtcaattgctagaaagattgaacaacgccgaaaggtagcaccaataaagacgacatttgaattagttgatgtgattaaagaaggaattccggcagcagctcgtcgtcatggtggtcatccagcgaaaaagagttttcaagctattcggatcgcagttaacgacgaattaggtgctttagaggaatcgttagaacaagcattagacttgttagatgttgggggacgaatcagtgtcattaccttccaatccctagaagatcggttagtaaagaccatgtttcgtgaaaagacttcattaagtggggatgtaccgcagggattaccagtaataccagcgggaatggaaccaaacttcaaattaattaataaaaagccgattgtagctagtgatgaagaattagcggcaaatcatcgtgcgcatagtgccaagttgaggataatcgagaaaattagagaaggaaagtgacagaattatggtttcaaatgcggcaaggcaactggcgggagagcagcaaccgcagcaagcgccaaggaaaaagacttatcaacaaccaaagatttctccaagtccggttagatggtcaaaatttgaaagatctttagtagcagtaggaagtttaatcacactgtgcttgatgattagcttactttctacgaaaattagtattaataatcagcaacggcgcttacaggatactcaaactcaaattactaaggcaaaaagcagtaatacaagtttgcagcaggaaatcgctgaattgacgactcaatcgcatttgaaatcagcagcacataaatatggattatcagataaaaattcaaatgtaaggaacgttaataaataatgaataagaagccacaacgaacgaaaaataggggacatagagaaaaccgagggacctttggcaaatggctctttctaatcacggttggattgtttaccttgtttatcgttcgttttgcgtatatcgcaataaataaagatgttcaacatgttaacttacggtcacaagcggagcaaatttatacccagcagcgaattattcaagcgcgacggggtgatatttatgattcagaaggaaaccccttggcaactgatacaagtaaatataccctctatgctgttttagatcgaacccaaaagtcttctgatggtaaaccattatatgtaaaagatcggaaaaaaactgccaaggtactatcacagtatattgatctgacaccaaagcaaattgaaaagatccttaaaccaaaggggcaagcctaccaagttgaatttggaaatgctggaagcaacctttctgtttcaacgatgcagaagatcaagaatcggcacttgccaggaattaattttattgcgactccagcacgtcaatatccagaaggcgaatttgcttctcaaataattgggatggcaactcctaaagttaaaaatgataatggaactgaagagactaatttagtgggccaattgggcttggaaggctactttaataaacaattaacgggaataaatgggttgagaaaagataaacaggacgtctatggataccagattgctaattcaaagcaggtaactaaaaaagccatcaacggtgataatatctacactacccttgattcacaaacccaacattttctcgaaaataaagttaataaagtttataaaagttctaacgccaatgcaatgactgcagttgtaatggaagctaaaacaggtaaaattattgccgctacgcaacggccaactcttcatgcagaaaataatcctgtttggcggaatatgttagttcaagatgcttatgaaccaggttcggtaatgaaaattttgtcattagctgctgctattgataccggacattttaatcctaatgcgacctttaattcgggaacatggactatgggtggcggaaaaatcactgattggtcaagttctggctggggaacaatttcctataaagatgcttttgatatgtctagtaatgttgggtttgctcatgtagaacaagacatgggagcagagacatggatgaagtacattaaacgatttggcctgttaaaaaaagttaatgttattggaatgagtaacgaggttaatggttatacttcattcaaagggattcttgctcaggcaaataccgcttttggacagggaattactgtaaatgttatgcagatgatgcaagcgttcagtgctattggcaataatggtaaaatgatgaagccttacattgttagcaaagttgtagatggtaatagcggaaagacgattcaaaaggtcaagcctaaagttgttggacaaccaataaaagcatcgacagcgaaaaaggtccttggttacatgcaaggcgttgtttacgaccaaaagggccttggccacgattaccaaattaagggttaccgaattgctggaaagaccgcaactgcacaaattggtggtgctcatggttattcaactggtgatacaaactacctttactcctttgccgggatggcaccagctaaaaacccaaagtatattatgtatgttacccttcgccaaccgcaaaaccttaaaaaaccagcaaccaaacaaattgccagcgtctttaatccgacaatgaaaatgttgttgagccaacaaaaagttgcagaaaaggccaagaaaaaggttattacaatgcctaatgttgttggtcaagcaagcgatgaagctaataaagaattatcaggtaaaggaatgcaggtaattgttgtaggttctggcaagaaagttaaacaacaatcagcagttccagacgaacaagtgttaacagatcaacatgttattcttgatactggtggcgagtataaaatgccggatatttctggatggagttctgcggatgttcaacaattagctaaggttcttaagctaaaagtaaaagaaaatggaaacggctatgttactcagcaaagtatttcccctgatacaactattaagcgtggaacgactttaaccgttcaatatgaagctaaaaactagcagagaaactaattggaggtaaatatgaatttcttaagtgcagttttgactattcttagttcattcttaattacgtttttattaatgccctcgttaattaaatattttcgggcaaaaaaagaaggtcagcagattcgtaaagaaggtcctacctggcatgctaaaaaggctgggacgccaacaatgggaggattattattcatcttctctgcagtagtaacgattttgtgggttgctgcttggcaaggattgattacgaatacgctgtgggcacttctctttgtcctggttgtttatggcttaattgggatgtgggatgatagtattaaaatctttcaccatcaaaatgaaggctttaaaccatggcaaaaggcgctatgccaggtattagcagcaatggtctttactgttatttaccagcatgaaggttttcaaatgggctttggaacaacgcaaattggttggctttacggtttgtttattattttttggatcgtcggcttttcaaatgctgttaatttaactgatggacttgatggcttggtaagcggcctttccattatttcttttgcggcttatctaatcattgcgttggtaaatctcaatcaaccaggttatccggaaattgctcttttctgtttagcaatgatcggaactttactaggtttcttcccttataatcataagcccgctaagatttttatgggtgatatgggatctttagcaattggagcatccttagccgctgtttcattgttattacatcatgaatggtcattattagtaattggaatcgtttatgtttgtgaaactgctagtgtcattcttcaagtggcttcattcaaaacaactggtaaacgaatttttaagatgaccccaatccaccatcattttgaaatgagcgggtggagtgaatggaaaattgatattgtgttttggcttgtagggttagtggctgcaattattgctgttacaacaatcttattagttggttaggagtaaagagaaatgaaaaaaattgatgaatatcaaggtaaaaaagttcttgtaatgggtttcggaattagcggaattaatgcagcccacttattggtaaaacttggtgcaaatgttaccgctaatgataaagcaactcctaaaaataatgatattgttgatgatttagaagctgatggaatcaaggtaattactggtgataatcccatttcattagctaatgaaggtttcgatgttgtagtaaaaaatcctggaattccttatgataatccattagtggctgcatttgttaagcaagggacacccattattacggaagcagaactaggatggcaaatttttgatggtcaccttgtaagtgtaaccggaagtaatgggaagactaccacaacgactttaactcaactaatgattgctgaaaatgcaaaacatcaagtaaaatatgcaggtaatattggaatttcctttagtaaaattgctgaggatttaggaccagacgacacattggtcacagaattatctagtttccaattattaggagcaccgacaattcatccgcatattgcaattattactaacattttttctaaccatttagactatcataagacacgagaaaactatattaatgcaaagcttaatattacccggaaccaaaccaaggatgatttcttagttattaactgggatcgtgatgaatggcagaagattgcccagcgtagtcaagctaccattgtgccattttctcgtcttaataagagtcatgaaggatcttatgtagaagatggaatgatttactggcgtgggcaagaagttatgccaaccaaggatattcgattgatcggtccccaaaatgtagaaaatgcgttggcagcaattgcagcggcaaaattaagtggtgttacaaatgatgcaataaagaaagttttaacaacatttagtggagtccgtcaccgcttacaatatgtgatggaataccaagaacggcttttctacaatgattcaaaatcaacagatattgaagccacggaggttgccttacaaggttttgatcgtccagtaattcttttggcaggtggccttgatcgtggttatacctttgaacggttggttccttactttaagaagcacgtcaaggcaatgattgtttttggtgaatgtaaagataaaatgaaggatgcgggaaatcaagctggggttccagtagttgaaagtgaaaatgcaattactgcggtaccagaagcatggaagttgagtgaaccaggagatgtcattctcctctcgcctgctaatgctagttgggaccaattcccgagctttgaagttcgtggtgataaatttattgaagcagttgaagaattaacaggaaagaaggaacagtaagatgcggttattggtatcaggtggtggaactggtggtcatatctacccggcattagcattaatcgaacgcttaaagcaggttgagccagatactgaagtgttatatgttggaacaactcgtggccttgaaaataaaattgtaccggatgccggaattgagcttgaaacaatgcatatgcagggctttaagcgttctctttctcttgaaaattttaagacaatctatctttttttaaactctgtccatcatgctaaaaaaattattagtgagtttaagcctgatgttgttttagggacgggaggatatgtaagtggagctgtcctatatgctgccgcaaagaaacatatcccaaccgtaattcatgaacagaatagcgttgttggcgtaacaaacaagtttttaagtcgctatgttgatcaaattgcaattgcatttgaagctgcacgcagtcaatttcccgctgataaagttacaatggcaggtaatcctcgtgctcaacaggtagcagctaaaaaagacagtgacttttcatggacaagatatgacttgaaagatgatgttccaactttaatgatttttggaggaagccaaggagcaccgaaaatcaataagacagttgtcgacgctattccagagttcaataagcgtccttatcaggttatctttgcaactggtcaaaaacggtacgatgatgtaaagaagcaactagcagaaggtaatattaaaccagctgataatgttaaagttgttccttacattaaagatatgccggctaaaatgcctcgggtagcggctttggtatcgcgagcaggtgcaaccaccattgctgaggtaacagcactcggagttcctacgattctaattcctagtccgtatgttaccgctaaccaccaagtaaagaatgctcaagctttagttaagaataatgccggtctaatgattactgaagacaaattagatgcccgggcattactgactcaagcagataagattatggaagatgaagaagtacgtaaagaaatggctcatgctgctgaaaagatgggacggccagatgctgctgatagactaattaagatcttgcataaggcaattgacgaacatgaaaaataaagtatagattagaaaggaggagaaaagatgttggatgatagatcagcaattgagcatcataaatattcacagcggctaactgaattagaaaagcgaagtgctgctgctcaacagcgacaacagcaaagaaagccttcgaaaactcatgttggtaataagattcgcgggattaagattaagcgctatgtttctaatggcgagcgagtcttaaaattagttgtattattcagtgttattctcctctttatgctttatattatttctcccttgagtaaaattaccacgcttcatgtaactggtaatcatgatttaactaaagaacaagtagaaaaaaatacaaatatttatccaggacggtttatttggggcgtttatcttgctcgtcatcaactcactaaacaagctattcgcaaaaatcctcaaataaaagatttaaggatcaaggtaaccggtccccagtctctgcaaatatctgtaaaagaaaatgcgcttttaggaacagcggtgatggataatgatacatacgctgtcttagctgacggccaattacagcgaacaaaaaatgctgataatggtattgcttataaacgttttgatggtcataaaaaagttcttgctacaacggccgctcagttaggaaagttgaaaccagcaataagaaatggtatttcaagtgtgagttatcaacctactaaagattatccagatcgcgttattatttatatgcgtgatggtaatacagtttatggcgacttaaatactatcggggataaaatgggatattaccctgcaattgcagcaagtatgaaaaataagggaattatagatcttcaagtcggagcttattcttatgattatggatctaaggataaatgattttgtgaaaaaccttgataattcccttttttgtcattgtttatctgtggtaaaattcttgtataggttaaaaatacaattaatttaattaatgatagtcttaggagggttccttttagaatgaataattcagaagtatacgttggattagatattggaaccacctcgatcaaggcactggtgtgtgaaagtgttaagggtcagttgaaagttattggtgttggtgtagaacgatcggcaggattaaaccgaggagttattgtcgacattgataaaaccgcccaggcaatttcagcggcggtagcacaggccgaggaaaagtccaacgtagagattcaaagtgttgtagttggcttaccggcaaattacttacaaatgcaacgagtacatggtatgattacgattgcaacaagaggacaatcaagagagattgttaaccaagacgtaattgacgttgctcgtgaagcgttgacgcaaagtattccccccgagcgggaaataattgatttaattccaacagaatttactgttgatggcttttctggtattaaggacccccgtggaatggttggtgtccgtttagaaatgaaggccaccttgtatacaggacctaagaccattattcataatacaaaaaaggcagttcaacaggcgggatatgacattaaagattttgttattacgccgatcgcaacagactttaatctccttaatgatggagagcaagattttggtactgttgttattgatttaggtggtggtcaaacaacaaccagtattattcatgatcatcaattaaagtatacttatgttgatcctgaaggtggaaaatacattactaaagatatttctacggtcatgaatacatcattaaaaaacgccgagcaacttaagctaaatcatggatatgctatggcatccttagccgatgaagatgttcaagttgacgttgatgttgttggccaaaatgatcctgtccaatattcagagcagtatttatcagaaataattgaagcacgagtacggcaaatttttgatcgtattcaggataaacttaaggctattcatgcccctgaattaccgggaggagtagttttgattggtggagtggctgctctgccaggagttaaggaacttgctgaacagtactttactggtaatattaaggtgaatgttccagaacaaatgggcattcgtcaccctcgttatgcggttagtttagctttggggatgtatgaaaatcagttatcagatattgatcgattaattaagcaaactgttcaacgaattgatacgattaagagtcctcatgaagaaaaaggacaaactgttaatcagccacgtcaacaatggactgaaaaatctgataaattacaacgttcacagcgagaagcacagcagcaaccagttactgaagagccagcgccaaagaagaaaaagcaaaacgggctaagtaatcggtttaaaaacatttttaataatttatttgactaatttggaggaatactgctatggataatgaaacgttcgctaacgacaaccaatttgcggaagcgcaaatcaaagtaattggtgttggtggagctggcggtaatgccgtcaaccgaatgatcactgaaaaagtacaaggtgttgactttattgttgctaacaccgacctacaagcattaaataattctcaagcaacaactaagatccgcttaggacctaaattgacaaaaggattaggtgctggttcaaatccagaagtaggtgaaaaggctgcccaagaaagtgaagagcaaattaaaaaagctcttgaaggcgcagatatggtcttcattacagccggaatgggtggtggaactggtactggagcagccccagttgtagctaaacttgctaaagatagtggagcattaactgttggtgttgtgactcgtccgttctcatttgaaggacctcgtcgagcacgctatgctgcagaaggacttgaaaagttaaagtcaaatgttgatactttaattatcgttgctaataaccgtttattagagatgattgataagaagacgccaatgatggaagcatttaaagaagctgataatgttcttcgtcaaggtgtgcaaggtatttcagacttaattgttactccaggttacatcaaccttgactttgctgatattaagacattgatgtctaatcaaggttctgccttaatgggggttggtgcttctactggtgaaaaccgtgctactgaagcaactaagaaggctatttcttctccattacttgaagtgtcaattgatggggctcaacatgtcttgatggatattactggtggtaaagacttgtcaatgtttgaagctcaagaagcatcagatgtgattaaacaagctgctggaactaacgttgatatttcatttggtatgtccttaaatgaatcaatgggcgatgaagttcgcgttactgtaattgccactggaattgataagaaaaagaaaattcaacaacaaaagccagcagaaaaagaggcaccacgagtaactcggtctattccacaagaagaacaacccgttgaacaaccaaagcaacgagatccttttgatggttggaatgatccaacagccgatacaagtaaccaatcaagaaattctgataacgaattttctcatgttactaagccagaatttaacgtatttaacgatgatgcggctaatacggatgacaatgatgatactaacttatcgactccaccgttcttcaagaatcgtcgtaagtaaataatctagcaaaaaggtggatttttaatccatctttttctgtttagcactattaaggaggttaaaacaatggcagcaaatttcttaaaaagtctatttggtgaagaagacattgatgaacaagatggtctctatgaaacaagtgaacaagtttcaacgccagcaaacacaagtaataaagtagtttcaattaatagcgggcgtcttaaccaaatgagtcagatttccttatatgagccccgtctttatgcagatgtaaagcagattgcgtctcaattattagaagggcatgcagtaatcgttaacttcactcaaatggatgcaaatgttgcagcacggttagtagatttcttgaatgggaccgtttttgcaattgatggtgaaatgaaacggatcggaaaggaaattttcctctgtacccctaaaaactatgaaatttcaggtagcttaacgagtaatctaaaaaatgatggtgataaattttagtcactaaaaggagttaacatgatcgcatttttattatgggctcttaatcaattagttgatgcttatattttagtaatagttgtgtggtgcattatgtcatggtttcctaatgcacgcaattcacgactcggtgatattatcaatcggttggtagaaccttatatgcattggtttgactttattcctccaattggtgggataagttttgcgccgatgatcgctatccttgtactatattttgttcaagcaggattagcacaaatagcagcaatcatttaattaatattaagaggaagtagatttgagcgaagataatattaaacaacattttcgtccggatgaagccacccttattgaccaagcaaatgactgggtagccactgcagaaggccaatatcgtcctgtcctcactccttttttaaatccgcgtgaacgttttattgtccaaacgattgttaatcgaaataacaatgttaaaataacaatgtatggtggttggcaaggcgcagaaatgcaacgagttttaatttatccgccttattatgaaccctctatagaagactttgctttacaggctttagagataaactatcctgttaagttttcagaacttcaccatcggcaaattatgggaacattgattggtgaagggatggagcggaatgcatttggtgatattttaactgacgggtcgcattggcaagttatcgtaacgaaaccaatggcagagtatttacggaaaaacgttgagcacgttggtcgaattaaggttaaatggattccgatcgcaacagaagcagtggtaacacctaaagaagaatgggtaccgatagttacaacagtttcatcactacggttagatgttgtgatagctgcaggctttaattattcacgaaaccgggcaaagcaattaatagagcatggtcaagttcgattaaactgggaagagattgatcgtccagattatcaaattgtggttcatgatttgatatctgtgcgtcatggtggtcgcctcagaatcgatatgaccaatgggaaaacaaaaaaagataaagaaagaattaccatttcagttgtaaatgcgtaatttgaatggaggaatttactcatgagtttgacggttgatcaaattaacaataagcaatttaatactaagatgcggggttataatcctgaagaagttcaagaatttattcaggaagtttcacaaacagtccaacaattaataactgaaaataataatttacaagagcaagtacgggctaatgatagcaagattaagtactttgctgacttgaaagattctttaaataagtcaattttagttgctcaagaggccgctgataaggttaaaaataatgctaagcgtgaagcagatattatgattcgtgaagcgcaaaagcaagcaaccgatattgtttcggaagctaatgataagtcaaatcaagtaattgaagacgctgctaattctactaagaagttaacaagtgaaactaatgatcttcgtaaacagactcggatcttccgtcaacggcttcaagtcatgcttgaatctcaattagaagtcattaagagtaatgaatgggacaagcttttggaaaatgatgacttgagtaaatatgacgaaattgaaaaaattttaggtagtcgtcttgacagcagttcagcaaccagtgtagaatcaactgcaacagctattagtgaagaacaacctgttgaatcagaacagccagttgcttctgctgaacaaccagaagagagtgcacctgcacaaccaacagctgttaacgatgacaaaggggcagatgcacctgaaactgttgtcgttttccctgataataacaagtaaatcactaggatcgtattttaataaaatcgttgaagagaattggaataattatcgtaacattaaagcgagtcaacaattggtgagaggttgataatgtttaactattcctgatcatctcggagtacctcatttgagttagttagaatgaggcggttcattatcgttatctaatgacatgaggaaactttaatcttaaggttttaaatccgggtggtaccgcgaagaagcttcgtcccagtaatgggaggaagcttttttattattaaaatacaagaattaatgaaaggggtagttacaatgcgtgttaaagatacgttaaaccttggccgtactaaatttccaatgcgcggaaagttacctgtaactgaggcacaacgggaacagctatgggaagaaaataaagtttatgaactacgacaaaaattaaatgaaggaaagcctacttttgttttacatgatgggcctccatatgctaacggtaatattcacattggccacgctatgaacaagatttctaaagattttattgtgcgctataagtcaatgtctggctaccgagcaccttatgttcctggttgggatactcacggattgccaattgaacaccaattgactaagtccggttacgaccgtaagaagatgagcttaactgaattccgtgatctttgtcgggaatatgcccttaagcaagttgataagcaacggactgactttaagcggttaggtgtaagtggtgaatgggatcatccataccttacccttgataaagaatttgaagctgctcaaattcgggtattcggcgaatttgctaagaaaggtctattataccaagctaagaagccagtttactggtcatggtcttcagaatcagccttagcagaagccgaagttgaatatcatgatgttgttgctaaaacagccttcttcgtagagcaaattaaagatggcaaaggccgtttagataatgatacatatttagttgtatggacgacaacaccatggactgttcctgcttctgaggcagttgcagttaatccaaagtttgattactctgttgtaaatccagcaaatgatgaccggaaatttgttgttgcaacagatctgcttgagaaattagcggaaaaacttggttgggaagattatgaagttgttgatcatttaatgggtcaagaacttgaagggatgactactcaacacccataccttgatcgtgatcttcttgttggtttagcagattatgttactgctgatgctggtactggccttgttcacactgctcctggatatggggatgatgattacaactttggtaaaaagtatgacttgccaatttttgccccaatcaatgatcaaggtgttttaactaaggaaaacggtgaaggctttgaaggggtattctaccaagatgctgatgatgtatctcttcaaaagctagaagaaaacaatgctttacttcttcaagagccattgcaacacagttacccatttgattggcggacaaagcaaccaatcatcttccgggcaactgatcaatggtttgtatcaattgaaaagatgcgccaaaatattttagatgccttagaagacgttaagtatcacccagaatggggaaaggttcgtcttcgcaatatgatcaaagaccgtggtgattgggtaatttctcgtcaacgtgtttggggtgtacctctaccaatcttctatgctgaagatggcacaccaatcatggaagaagaaacaatcaaccatgtagcagaattatttgctaagtatggttctaatgtttggtttgaacgtgaagcaaaagatcttttgccagaaggatacactaatgaacattctcctaatggtaagttcactaaggaaactgacattatggacgtatggtttgattctggttcatcacaccaaggggtattagctgaacgtgattacttaacatacccagcggacctttaccttgaagggtctgaccaataccgtggttggtttaactctagtttgattaccagtgttgtatgttcaggacatgcgccatataaggaaatcgtttctcaagggttcacacttgataagcgcggtaacaagatgagtaaatctcaaggtaacgttatcgatccaaataaggttgttcaacaaatgggtgcggaaattatccggttatgggtaatgagtgctgatacttcggctgatgttcgtgtatcgatgggaacattccaacagatttccgaagcatatcgtaagttgagaaatacgttccgcttcttacttgctaatactagtgacttcaatcctgaagaaaatactgtttcttatgagaagttacaatcggtagacaagtacatgttggttaaacttaaccacttcttgaagacaatgcgggaagattttgataactatgacttccttgatgcttataaggtattgatcaattttgtaaacaacgatctttcagctttctacatgaacattgctaaagatgtgctctatattgaggctgaaaattcagaagttcggcggtcaatgcaaactgtcttctatgatatccttttgacacttgttaagcttcttacaccaatccttcctcacactacagaagaagtatggagctacatgaatgaaccggaagattttgttcaattaactgaaattccagatccacggacattcgctggtgaagaagagctattgagcaagtgggatgactttatggaagtacgttcacatgttctgaagagtcttgaagaggcacggaatgctaagctaatcggtaaatctcttgaagctcaagttgatctttacttaaccgatgaccaaaagcaattacttgatagtcttaatgaaaacattcaattattgctaggggtttctgctcttcatgtacatccagctgatgaagcgcctgctgatgctgaccaatacaacgatggggtagcagttaaggttacaaccgctaatggtgaaacttgtgctcgttgtcgtatggtcaaggaagacgttggcagtgatccagcatatcctgaattatgtgctcgctgtgctgctattgttcgggaaaacttccctgaaacagcagaagatggtttagaagaataataatctctaaaaaaactggttttcgttatccagtaaatgacaattatttttaagcggtgtaaaataccaagtgacacttgttgcttggtattttattatggagttggtaaaaatgctcaaaggaaaagtaaaaagttttgacgaacaaaaaggatggggctttattacagttccccatgaaggagaaatttttgttcattatagtggaattgaaggaacgcgtcgtcgcatccttcaccctgatgaagaggtctcattagtaattgttcaaggacaaaagggaccgcaagcagcacatgttcgtgttttaagataaggatgggttctaatggaatttgaagagcgaccaataagtagtaaaacagtttttcacggccatttaatcgatgttgaagtacagcaagttatcaccccacatggtaataaaacacaacgagaaatcgtccaccacgcaccagcaattgcgattttggctttgacggctgataataaaatgattcttgaaaaacagtggcgcgcaccaattgcaaaaacaacccttgaaattcctgcggggaagctcgatcaacgtgatgctgataatgctcttcatgcggctaaacgtgaattaaatgaagaaacaaggtatgaagcaacaagtttaaaaaagatttcttcattttatacttctgttggttgtatggatgaatacatgactctttatttggccacgggattaaaacgggttagcaacgagctgccgcaagatcaagatgaacaattgatgttaaaagaagtaactttaccacaagcgcttgaaatgattgatcaaggcgaaattgaagatgctaagacaatcatggcaatctattactggcaaggaatgaacaaccgtggataataaacaacaagatgagcaacaatcacgtatgtcacgtagccaatatcgtcaacagcaacgtcagactgaacagcaacctattaatgaagcaacagaaaatacaactgatcaaccttatagtcgcgaagcagttgctagtcaacgtcatgacgaaacagtggcagaaaaaacggcgcgcttgaaacgccgcttaaatattgcaatcattgctttgattgtggcaattattattgtttacttaatactattttatgttggatagaaaaaggagaaaaatatgcgatttggaattatttgtgcaatgcctgaagaaattaaagaattaactgcaaagttatctgataaacaagagaagaaaatcgggggtaaatcctaccttttcggtaaaatcaataatcaagacgttgtattagtagaatctggaattggtaaagtggaagctgggattactactgaacatttaattaccgattgtggggcagatgttgtgattaattctggatcagctggtggaattggtgaagggttacatgttggtgatattgtaatttcaactgaaacggcctaccatgatgttgatgcaactgcatttaattaccgttatggccaactcccaggaaaagaaccacgctttaaggcttctgaccaatggggacaagccttagaaaaagccggtgaaaagactggcttaaatgtaaaacgaggattaattgtttctggtgatcaatttattgcaagttcagaagcaattaaagagattttgaataatttccctgatgcactttctagtgaaatggaaggggcagcggttggacaagttgccactgaccaccaaattccatatgtggtagttcgggcaatgtctgatacaggtgatgaagatgccggcgttagttttgacgactttattattgatgccggaaaacgctctgcaaatatgcttcttcagctctttgcagatttagataagtaaatggaaggatgaaaaactcgtgagtgagatttatttggataatgcagcaacaaccccaatgaccccagaagtaattgcggaagtgactaaacaaatgcaagaatcatggggaaatgcctcaactggttactcttatgggcgtcatgccaaacttgtaatggaagatagtcgtcacattcttgcccaaagcattaatgctgacgataatgagattatctttactagtgggggaactgaaagtgataatactgctattatccaaactgcttttaaacggcagaatcttggtaagcatattattacaactgccattgagcatgaggcagtcttaaaacctctccattttttagaagaacatggctttgaggtaacctatttaccagttgatgaaaatggtaatatctcaattgatgattttaaggccgctcttcgtgatgatacgattttagtaaccattatgatggaaaacaatgaagtgggtagtcaaatgcctatccatgagattggtgaaattttgaaggaacatcaagcatggtttcatacagatgctgttcaagcatatggactgttgccaatcgatgttaaagctgaccacattgatatgctttcaacatctgcccataagattaatgggccaaagatgatgggctttttatatcgtcgtgatggcattagttttccaagctttattaagggtggagatcaagaaactaaacgccgtgcggggactgaaaatgtgcctggaattgccggttttgctaaagcggtagaattaaacacgccggaagtaaaagaagaacggcgcgatcgttattacgtctttaagcaaaagattgttaacgcacttaaggaaaataatgttgattttgaaattaatggtcaaatcaacaaaactcacgtacttaacttatggtttaaaggcatttcaacttatgttatccagacagacttagaccttgcaggcatcgcagtctctggtgggtctgcatgtacggcgggtagtattgagccatctcacgttttaacagcgatgtttggcgctgatagcccccgaattagtgaatcaattcgaattagttttggcgggttaaatacggaagaagatattgatcagttaattgctacgattgttaaaaccgttgaaaacctaaagaaaattaatggggataattaaaatggaatttacaaaaacagtacaaatttctggtgataaggataaatacacaattagcccagagataaaaaaatatgctttgcttgatttaggatttgaacagacgaaccggggaaactttgaatatttaggaagtcttgatactgataatccatttaaacctgtagcccgtcttcggattttaattaacagtgatttagacggttttaaaatggagactctttcgggaaatggtttaagaaaaattaatatttttaatcaccaacgcgcagctgaatttattcaacaatatcactatattttagatgaaatggttgcccggcaaatattcactaaataaaaactgtgcagggattgaaatactctggtacaatggttaacactggatgcatgcgaccttcaatcgtagattattccagaatctatacgaaatgatggtgataattaatggctgataatagtcatacacgtgtggtagtaggaatgagtggaggagtcgactcttcagtgacggctcttctcttaaagcgccaaggatacgatgttgttggtgtcttcatgaaaaactgggatgacactgatgaaaatggtgtttgtactgccactgaagactacaaagatgtagcaaaagttgcttctaagattgggattccatactattctgttaactttgagaaggaatactgggatcgggttttcaagtatttcattgctgaatacaagaaaggtcgtacaccaaatcctgatgttatttgtaataaagagatcaagttcaaggcttttattgaatatgctaaccaattaggtgctgattacgttgctactgggcactatgctgatgtaaagcgtgatgagaacggccggatgcacttgatgcgtgctaaagaccaacacaaggatcaaacttacttcttaagtcaacttgattacaagcagttggataaggtaatgtttccattagctggctacactaagccagaaattagaaagattgctgaagaagcagggcttgctactgctgataagaaggattctgttgggatttgctttatcggtgaggatggtcattttcgtgaattcttgagtcaatatattccagcacaaccgggaaatatggaaacccttgatggcaaagttgttggtcagcatatgggcttaatgtattacaccatcggtcaacgtcgtgggcttggccttggtggtaataaggaaagtaatgagccatggtttgtaatcggtaaggatatgaagaagaacgttctttatgttggtcaaggatacgaaaacagccatctttatgctactcatcttgaagcgagtgatattcactgggttgatgatgttgtaagtcgttatgggcgtgattttcattgtacggccaagttccgctaccgtcagacagatgttggcgttactgttcatttgtcagatgatgatcaaatggtaacagttgaatttgatgatcctgcacgggccatcactccaggtcaagcagttgtcttttacgatggagaggaatgccttgggagtgcgattattgatcgtgcttacagtcatgaccggcagcttcaatacgtttaattcatatttttagactttaaagaaggcaggggtaatttcacttttgccttcttaaatatacataaagtaataactctgtgataaacaattgccgcaaactctggtaagatagtaaataaaaggggtaacgacagagatgacaaaagtttatttaatccggcatggaaaaacgcaatggaatttagaatcccgttatcaaggtgccaatggcgattcaccgttactaaaggatagttatcgagaaattgaattattagcaagttctttacaaaggattccgtttgaatacgcttatactagtcctttaaagcgtgcgcgcgtaacagctcaggcattattgaaccatttgaatccagaaatcccattaacaattgatagtcggttaaaagaatttaatttaggcaaaatggaaggaatgcattttgaagacgttgcggcaaaatggcctgaagtcttaaaaaactttcgtcatcatcctgataaatatgatgaatcattagtagaaggagaaagttttctagaagtaatcgctcgtttccgtgcagcaattgaagagtattgtcgccagtatcctaatggtaatattctcgtgatttcacacggagctgccttgaatgctgccattaatgcattgattggaacaccgcttgctcacttgaaagatcgtggtggactaagcaatacatcaacgacgattcttactactaatgatggtcgccattttgaacttgaaaaatggaatgatacatcttaccttcacaagagcaaggttgatccgactgatacgatttaagaggtgatattaatgacagagaaaaaagattttcgtgatcctaagaaaaaggaaacagaaaaattagttcataaactagttgaagcaattgatgagcatccagataaagtaaataattattatgatttaggttctttgctaacccggttaaatgactatcaacaagcagaagaactctttatgaaggctttggggatttttgaggcaaagggtgacaaggatgctatgaacctcttaaactatggtcttggtaacctttactatgagattggcaaagttaacgaagcaattaagctttataataagattgatgactccaaactcaaagctgattcttatcttatgttagcccaaagctatatgaaaaaaggacaatacaagcaagctgttgcttatggattaactgcccttgaattacgtccagatgatcctgaaattaatcaggtaatcggtgactcattattagcattaggcgaatttaaacaggctaaagcttactatgatgcaattctaaagtatcatccaggacgtgctgatacacaatttaatcgcggaattgtagcgatggttcttggtgagccatacaaagactaccttgcgcaagctaagcagttagatcctaattactaccataagagtgagcaacgacttaatgatattgaaaaaacgcttcaggcaacgcaaaagaaagattagcaacatgaaaggatgacttctatggctgaagaaatcgacctatttaagacgccaacggagccgtctttttttattggtcaggtacaatctgagatttttactagtccagattcgttttttaaggttttaattgtctcggttgaagaagcaaattttgattggcacgagccggagattactgtaacgggaagttttggtgatcttagtgatgatcagacttaccgctttgagggaaaaattgttgagcatccgcgatatgggcaacagtttcaagcgacttcttaccatgtcaatcggcccacaagcaaggatgggttaattgatttcttgtctggaaaacagtttaccggaattggaaaaaagacggctgaaaaaattgtcgataaattaggaacggatgcgattaataaaattattgctgacccccatgttttagatgaattaaaactccgcaaagcagttaaggattcattagttgataatttacgagcacaccaggggatggaccagattattatcggcctaaatgatctcggctttggcgctaaccttagtagtgcaatttttgacaagtacggagaagaaactctgcatattattaatgaaaatccttaccaactcgctgctgagatagatggaattagctttaatcgggctgatcaggtggcacagaaattaggaatcgccacggatgattcacgtcgaattgatgccgcaattatccagacgcttgatgacttgacaatggagactggtgatacatttactacaacaaaacctcttctgcagcaaactatccagttgcttgcccaaggaagtgggggtcgtgtttcgaccgatttaattgccaaccaaattgttgagctagagaaaaatcaagcaattagttatgcggatgaaaaaatttatccaactgccctttataacgcggaatggcaaattgctgatcacttacatcgtcttcttaccgttgaccaggaaaaagtaccagcaacgactattgagaaaacagttacgaaggttgccgatcaatcggggataacctatgaccaagttcaaaaagaggccatcaaaacagccttaaatagtaaagttatgcttcttacgggaggcccaggaacgggaaaaacaacaattattaaagggattgtagcaagttatgcgaaaattcatgatctttcattggacgtaaatgaatataaagaaaagtcatttcctgttttactagctgctcctacaggccgtgctgctaaacgaatgagtgaagctactgatttaccagcaagtacaattcaccgcttgctagggcttaatggccgggaaatgccaactgatatgaatgcccgcgatttagaaggctcgttattgattattgatgaaatgtcgatggtcgataccctcttgtttaagactcttattcaagccgtccctacttctatgcatgtagttttggtaggtgataaagaccaattaccatctgttggtcccgggcaagttttccatgatcttcttgactttgcagaactgcccaaagttgaactgaccaatattcaccgccaggctgctgattcaacaattatcccattagctcatgctatcaaagagggtaagctaccatcagatctaacgaataaaatgccagatcgatcatttatctcatgccatgctaaccaagtgccaagtgtggttcaacaaattattgacctttctaaaaaacgagattattccgcaaatgatattcaaatcttggcaccaatgtaccgtggacaggcagggatcgatcgtttgaatgagcttgcacaacaggcgtataatcctccagctaatggaaagcaagaagtcgattttaggggactaacttttcgtgttggagataaggttctgcaactcgttaatgttccagaaaagaacatttttaatggtgacattggaaaaatcacagcaattgaaagcggtaggacagtcggtaagaaaaatgaatcaattactgtcgattttgatggtaatgaagtgagttatagccgcatggaatggaatcaattacggttagcttattgtatttcgatccataaagcacagggaagtcagtttaagatggttcttttgccaattgttcagcagtttagccggatgcttcaacgaaatcttttatatacagcgattactcgtgccgcagaaaagctagttttgatcggtgagccatatgcggctgtgactagtgtaaaaaatgaagcagttaaccgaaaaacttctttggttgatcgcctcggtagggtttggaataggcatggtgaactaaaatcaaacttagatcatcaaacagattcattaacaaaagaacttgctagttcccaaccagttcaaaaacaaactgaacaattaataaataatgatgctcagcaatatattctaacagctgatctcattaattcagatacaattgatccattaatcggaatggaaaatattagcttacaaagtttgcatcaagtcaaataatacttgcttgaacagtaatttgttgtcataatagttatgattattgtcgaactttaaaggagtataaaaatgacccagataaaaaatgccgataatgtgcgtttattttcactaaattcaaatccaaaactagctgaacaaatttctcaacgcgtggggattccgttgagtaaagcttccattagtcattttgctgatggtgaaattaaaattacaattgacgaaagtattcgtggctgtgaggtttatgtcatccagtcagtttctgatccggttaacactaacttgatggaactattgattatggttgatgctttacgacgggcaagtgcagccaagattaacgtagtaatgccatactatggttatgcacgtcaagatcgaaaagcacgaagccgtgaaccaattacagctaagttgatcgccaaccttcttgaaatggatcaaattagccgactagtaacgattgaccttcatgctcctcaagttcaaggtttctttgatattcctgttgatcatcttcaagcaaccagtctttttaccaaatatattgaagagcaaaacttgggggatgatattgtagtagttgcccctgatcatgccggtgttaatttagcacggaaatatgctgaacgaattaaagcgtctattgcgattattgacaaccgtaacgatgaagttcgggaacggactgaacaagaagtacctgagtatgtaattggagacgtaaagggaaagactgcgattattgttgacgatattgttgatactggtgtccggatgaacttatctgcgcaagccttgaagaattttggggcagctaaggtttatggtattgctacgcacgcagtattatcagccgatgcggtaaatacgttgcaaaattctcctcttgaaaagatgattgtaacagatacaattcaattgccaaaagagaaagaattctctaagttggttcaattatcagtggacgatttattaaaagaagcaattgttcgtatccacaataaccaatcaattgatacattgtttaatcgtaaataaattaaaaatcgatgaaaattcagagttgaaactgaattttcatcgatttttatcttttaaatttttttaattttcaaattttaaggaaggtagtgaattaacaaaagccaaatatgctttgttttcagccgtttcaacgctactgctttgaagctcatcaagattttcttggtgaattgttgactcctctacagtaataatattagtaaacgtagcattaccgattaattcgatccagtagttgtagtcatcacggtgaagaattgtcttgaccatgccaccaggattgtaaacactaattggttcattaaatgatgctgcgtctggatgagtgagggctaaagcgagactagtggcagacatacctgttccacaagcatttgtaaagccgactcctcgttcaaacgtttttacaaagagtttgttatgaccgagaatatggccaaagttaacatttactccatcgctgaagtaaggattatcactatttaaccgtgtacctaattctttaagcgctgagccatttagttcttccatactaacaaaactaattaagtggggattaggaacagcaagggctgaaaaacggaggctaggatataattcagggacgagggtgtctaataggcgcttgtgaccaagattatcaaatggcaaagcagtgcggtcaaactttactggtgaaatttcaacggcaaaagcgggaactccgggtgcaaggtcttcatgctgacgaacacgaagactagcattcattgtatcgactttaaaatcggttaaattatcacgttctgctacatagcgagcaaccgttcttaaaccattgccgcacattgaggcctcactgccatctgcgttaattacccgcatttgtgctgctgatcctggtctagttggatggttaacaactaaaacgccatcagcaccaccgagaacgccattttgtgcatcggttatttgctgggtaaacgaaactaattcttcatcgttaaggggattggtcagttgtgtttggtcaagaataaaaaaggcattttgtgatccgtggacttttaataattgcaccataaatagttcctcctaatttgcgaaaaagcgatggtaaatagctcgaacagcttcatctgcatcttcgttgtatgtcccaatcataattgcaattcgtgaagctccttgattaatcatgggaaccgcaatgtgtttttcagctaggggcattaaaatatcatcgattacccccgtgcgattacgcataccttcaccaacaaccatggtaattgcataattgtcaatccattctaaacggtcaggattaatctcttcttgaatttcattgcagatggtatcgattaattggtcattaattgcattccgatcaaggataattgttatatcatcgattcctgaaggcatatgttcgtatgagacgttgtgctttgcgagaatttcaaggatccgaagagtaaaacctgcttgcttgttaaggagatatttgtgcaggtagagggctgcaaagtgttttccgctcacgacccccgttacaatgtcgcttggttgaaaatctttatcagggacaatcattgttcctggcttttcagggtcattagtattacgaacattgattggaatatttccttgaatggcaggaatcagtgcttcatcgtgaaagacggaaaaaccagcgtaagatagttcccgcatttctcggtaagtcatggttgtaattggttgcggatgatcaacaatttgtggattggctgagtaaatagcatcaacatcggtgaaattttcataagtggaggcgtgaagaccgcgcgcaagaatcgcaccggtgatatcagaaccgccacgggaaaaagtagcaatgtgtccggcaagggtgagaccatagaaaccggggaatattaataattcgttttcattaaacgtaaaatgactcaagtttgcatatgtttctgggataacattagcattattgggagttccagtaacaataataccagcttcacttggtgtcacaaaacgtgcttcataacctaaatgctgcaaaaggatggccattagttgggcatttaagcgttcaccatgagctttgaaagcagccaagagatagttatcatttggatacgtatggttaggaaggccttccagtcgttcggctagcggaattaatttatctgctggtaagccaaaataagcagcaatctcttgatatcgatttaaaatttgttcaacgatttcttgagggttttggcctgcaattactgtttgggcatatttaatcagtaagtcagtaaccttaatatcatcggcaaaacgtttacccggtgcagaagtgacaattacccggcgttgtgggtcagaggtaataatattaattgcattttgaaaggcttctccattagccagagaacttccaccaaactttacgactttcatacttaaaatactcctttgagataattagggttgctaatttatctctaaaataatttaatcgaattctaacacattggaggtgacatgcaagcctttaagttacgaaaatttagtgaaattaactttcttacatctaatagattaaaaaaacttttttaaatttaattatttatattgacattctcataaaagacttataagctatgtataaatcgaagaggcgcaaccgacactagtaaactaatttagttcgccaagacattgaggttagttgaacagggaagttgccgaagcgcttagtttggcatattaagcagctgggtcgtagttgaataagctacggactgtcgcaggacaataagagcctgcgttgcgctatcgacaaatcagaatggataagtgaattccactgtttgtttgcgcagacagtggatttttttatacagcctctttactacaaacttcatggaggaattacaaatgaacgaacaaatttctgatcaacaaataaacgctgctggtcacctaacaattgggggatgtgatgcagttgatttagctcaccggtttggtaccccgttagttgtttatgatgttcaacagattcgtaaccagatccgagcatttaagcaggtttttgaagaaaacagtgttgattatgcagttagctatgcaagtaaagctttttcagcaatcgcaatgtatcaagtagttgctgcagaaggtgcgcatgttgatgttgtttctggtggtgaattgtatacggcaatcaaagcgggctttccaatggctaatgttagttttcacgggaataataaatcacgggaagaattggaaatggcaattgaccatcacgtgggaacaatcatgattgataacttccatgagattgaattgctggcagacgttttggaagagcatgatgcgcatgttgatgtgatgttgcgaattactcctggaatttctgctcatacaaataagtacattcaaactggtcaagttgacagtaaatttggatttgaccttcaatcaggacaggcagatgaggcgttaacaaaagttcttgaaaatccccggatgcaaatgaaaggattgcatgcccatattggttcacagatttttgaacttgcgggatttgaaggagtagctaagaagttagttgaagttgccgcccactggcaagaaaaattcaactaccaagctgctgtgatcaacgttggaggtggctttggaattcgttatgtaaaagatgatacaccacttgctccagaagaatttgtggcagcaattattaaggccatcaaaactgaaattaaagaaacaaaccttgccatgccggcaatctggatagaaccaggacgctcaatcgcggggcctgctggctataatctttatactgttggatcacgtaaagatgtaccaggattgaagccatatgtaacagttgatggcgggatgggcgataacattcgtccagcactttatgaagcacaatatgaaacggtcttagcaaataatcctcgggcggaattggttgaacatgttcgggtggcaggaaagtattgcgagtctggtgatatccttagtcagaatcaggcattaccggctacgaaaccaggggatgtcttggcaatgcttgatactggtgcttatggctattcaatggcttcaaattataatcggaatcctcgtccagcagttgtctttgcagaaaaaggcacagcccaggttgtaattaaacgagaaacttacgatgatttaattcatttggatgaaccataccaacaataatgtgacatatataaaggaagaaagaggtaaataattatggctgaattagatgcacaaacaatcattaactacattagtaacgcacccaagaagacaccggtaaaggtctaccttaaaggaaatttgggtgatttagaatttcccgcagaagtagaaacatttcttgaacagcatacgggtgttattttcggtgattggacagttatcgaaccgttattaaaggaatacagttcagcaattgaatcttaccatgtggaaaacgatgcgcgtaattcagcagttcctttgcttgatttgaagaatattaatgcccgcattgagccgggagcaattattcgcgataaagtgcttattggtgacaatgctgtcattatgatgggcgcaacaattaatattggtgctgaaattggtgccgattcgatgattgatatgggggcagttcttggtggccgtgcaattgttggtcgccactgtcatattggtgctggtactgtcttagctggagttgttgaaccggcttcagctgaaccagtccgcattgatgacaatgtaatggttggcgccaatgcggtggtaattgaaggggttcatgtaggagaaggagctgtcattgctgctggggcaattgttactcatgatgtggctcctcatacgatggttgcgggagttcctgctaagtttattaaaaatgtcgatgatcaaaccgctggcaagaccgaattagaggatgatttacggaagctctaggaggagttcaagatgttaacagaagaagaattaattcaaattcgtcgtcacctccatcaaattccagagctggctcttcaagaatttgacactcaccaatacttagtggagacgattgctggttttaaccaagcctttttagaagttcgtacctttaaggaattaccaactgctctcatggtgttggtgcatggtaagaatccacaacgaacaattgggtatcgaacagacatcgatgctttaccagttgaggaacaaacaggtttaccatactcatcaacccatccgggagtaatgcacgcctgtggtcatgatattcatatgacggttgcattaggggtattgaattattttagtgaacaccagccgcaagataatatcctgtttttctttcaaccggccgaagaaagcgaaaatggtggaaagcgggcatatgaactgggtttgtttagtggaaagtggaaaccagatgagttttacgggttgcatgataatcctgatttgccagcaggcgcaattggttgtcggatggggaccttgtttgcgggaaccacggaagttaatattgatctcaatggtaagggcggtcacgcggcgtatcctcaaaatgctaatgataccgtcgttgcggcagcatcattgattcttcaagtacagactgtgatttcgcggagtatcgatcctattcaaagtggtgtaattaccttaggaaagattgacggcgggacgattcgaaatgttattgctggacatacgcggattgaaggaacgattcggggactaacgcagacgatgattgaaactattgataaccgcttgaaggacgtatgtgaaggaatcgggtgtagttttaacatggatgtttcccttgaattaaatcagggtggctattggccagtagagaataatccagaattaacaaaacggtttatccattatatggaagagacaccaactgtaaactttatcgaaacagaacccgcaatgaccggggaagattttggctacttactggctaaatttccgggaaccatgttttggcttggggttgaagatgattcacaattgcattcggccacccttacccctaatgaaaaagcaattaaacgtggagtagatgcgattactggttttcttgaatatcgaatgcaaaattagtagggaataaataatggaggaaagaatatgacattattacaaaatgcagacttaatgacggcaattgtaaccccctttgatgacgaggaaaatattgattatggtcgtttagaatatttgacaaattacttaattgaacatgggagcaacggttttgttatcggggggactactggggaaactccagaactcactcatgatgaaaaaattgagctataccaacatttcggtgaaattgtaaacggacgggttccggttattgctggaactggaagcaataatactaaggaaacgattgcctttactaatgaggttgcgcaaattaacggtatcgattatgcccttgttgttgttcctccttataacaaacctaaccaacggggaatggttgctcatttcacagcagttgcggatagtgttgacctcccaatcatcatttacaacattcctggtcgtacaggggtaaagatggctcaggaaaccgtagtagaattgtctcaccatcaaaatatcgccgctgtaaaacaatgtacatctttggaagaacttgaatacattgttgaacaccgcgaccctgattttgcagttttcacaggtgaagatgcacaggcgctaactgcccgggttttaggagcaaatggggttatctcggttgcttcccatacttatgtcgatcaaatgcgccaaatgtatgactcactataccgaggcgattatcaaactgctggtaagttgcaacggtggctaactccccggatggccgctttgtttatgttcccatcaccatcaccagttaaagcagttttgaatgcgcaaggttttaacgttggtagttgtcgattaccaattcttccattaaatgaagaagaaaaacgcaaattagagactgccttatcattacctactaattcgttgactgccaagaacttacctttaaatttgggggaataaagcatgaaaaaagttttaattgctggtgcgactggagcaatgggacaaaaggcagttgatctagtgaactcactcgctgggtttgaaattaccgctgcgcttgcaccaaccttaacaaaagagaatatgactgattttcaccttgcatcatctgttcagccttatcaaactttggatgaaattgaagatggagttgctgatatttggattgattttaccttgccaagtgctgtttatcagaatgttaagtttgcacttgaacatggaatgaggccgattgttggaacgaccggcttaaccgatgaacaacaagcagacctggtgcgcctcagtgaagaaaaacagataggtggattgatcgctgctaattttgggatgtcggcagttcttcttatgaaatttgctcaggaagcagctaaatatttcccggacgttgaaattattgaaatgcatcatggtgataaaaaagatgccccatcgggaacggctttgagtaccgcaaagttgatcgatcaagtccgtcctgcacatgagacaaatcctgatgaaacagagagcttaaccggtgcgcggggtggcgactaccatggaattaagattcatgctgttcgacttccggggtacattgctcacgaacaagttctctttggtggggatggcgaggccctaactatccgccaagactcgtttgaccgtcaatcctttatgaatggggttaaggttgctctggaaaaagttgatggattatcaaaattggtaattggtttagaaaatattttataagaaggtgaaaaaatgccaagacttcatgctgaattagcaactaccgtaaatagtcatctggcagctgttccgccagcacagattcgcgcatttgatgaagaaatttctgccgttcctggactagtaaaattaacacttggtgaaccggactttgctgtgccagatcacgtcaaaaaagcggcaattgaaagtattcaaaatgatgattctcactattcaccaagcaagggtaagattgaattacgcaaagcgattagtaaatatcttgagcagagtcgtcacgtttactatgaccctgaagccgaaattgtagtaacgattggggcaacagaagcggtaaccgcgacaacttttgcaatgttaaatccgggagataaagtaattattcccactccagcattttcgctatatttcccgagtgtttccctaactggtactgaaccgatcaaagttaacactgctgatgatggctttttgctatctgctgaaagactagaagaggtattagcaaaagagggtccggcagtaaaggctgttctcttaaattatcctaataatccaactggccgttcatacactgaagaagagctaaaagcattggctaaagtaattgaagatcatcacatctatgcgattgttgatgagatttatagttcattgatgtacgatcaaccattccattcacttgcgacgcttttgcctgagcagacaattctgattagtggcttatcaaaatcacatgcaatgacgggttatcgtttaggatatgtggctggcccgggagaatttatttcaacgatgtcaaagatgcattcatttatggtgacgtgcccaaatgacactgctcaagcggcagcgattgaagcgttagaaaacgggaatgatgatccgcaagaatttaagcgggtctatcgtcaacggagagataaacttgcgagtgcaatgcgaaagatgggctttgaaattgcattgccagatggcgcattttatatttttgctaaaatccctgctcaatttgggaaggatgatctcgcctttgctcgtaaattagcccacgaagctaaagttggcgtaattcccgggaatgcatttggtcctggtggagaaggatacattcgcttatcatatgcagcggcagattctgttattgatacggcgattgaacggttacaaaattttatgaataatttaggataggttgaaagaaggaactaagatgagtaaagaatataatgtcgcaattttgggtgctactggtgcggttggtacacggatgattcaacaattggaacaatcaacaattccggtaaagagtgtgaaattactggcatccgctaagtcagctggtaagcaattatcatttaagggtcaaccgatcactgttgaagaaacgacacctgattcttttaatggggttgatattgtgctttcatctgctggtggatcagtatcaaaaaagttccttccagaagcagtaaaacggggagcagtttgtgttgataatacgagtgcttttcgaatggaacctgatgtaccgctagtagttccagaagtaaatgaagaggcattaaaaaatcatcacggaatcattgctaatcctaactgttcgacaattcaaatggtggtagcattggaaccaatccgccaagcatttggattgaatcaaattattgtttcgacttaccaagcagcttcaggagcaggtcaatcagctttaaatgaattgcgacaagaaactcaagactaccttgagggtaaggacatgcaagcagatgccaagattttgccaacaaagggtgacaagaagcattatccattagcttttaatttattaccgcagatcgatgtctttgaagatgatggttactcccatgaagaatggaagatgatccatgaaacaaagaagatcatgttaaacgacatggacgctaaggatattaaggttactgccacttgtgttcgtgtacctgtcccaattgctcatggagaatcaatttactttactgttgacgatccaacggtaactgttgaccaattgcgggcagtattaaaggacgctcccggggtagttctgcaggatgatcctgcgcaccaggtttatcctcaaccaattaatgctgttggcaagcgtgacacttttgttggtcgtctccgtgcagatgaagaaaatcctggttcctttaatatgtgggttgttgctgataatctccttaagggggcggcttggaataccgttgaaaatgcagaacggttagtcgcaaatgggttagtttaaaatttaataatcataataaaaaatactctctgaatatagggagtattttttgtatgattatagagtttgttgatagtaaaaagtaatgtagccaataaaaagttgaaataagtcttcagtatttttaggatctagttcaaaaagtttttttatgcgaagtaatcgattattgagtgtattacagtgtacaaataaattatgtgcagtttgatttacactcatattacacttaataaattcacggattgtatcgatcaattctttcccatcttttctttttagtaaggcttcatattgatcattaactgctattaaatttaaatcactatctaatacctgtttaacaaaagaaatttgtgaataatacctaaatgatggctttcccaaaatattacttaatcgcagtgttgtaactgcttgctccgctaatctaccaagcaaattaccccaattactgataccgtattcaatttcttgatgttcaagtttttgttgaatatatgcttcttggtgctttgaactgagaataatcaactcaatacgattagtgagagaaaaaataattgtttcctgatctagtttaaggtttttaattatttgagaactcccggcaattgcaattacacatcgttgttttcctaaatttatatttagacgatttgcttcctcaactagttcactatcaagttgtggatcttgatacttgctgacattaagccacctataaataaatctttgtttaactttttcaatttcgtgctcttgttcattttcttgtttttgctgtagcaagagttcgactgctgtttttagcaatgatgctaggggagtaactttattagggtcaccggtaattccaacaacaccgataatttaatttttgaattttaaaggcatattaacgcctggttgcccatgatttccatattgttgatccattggtagtgtttttcgctgttttatcgcatcgacagctccaacatgtaaagtatttatcctacttttgttaccgcttgcgatgatataacctttcttattcataatattaatgttatatggtatttgtgtcatcatatgatcgacaattgattgtgcaagttttggtttgagctccatcatttttctcctttaatattttgataataggaactatgtacaagatgcataataatttttgtgcaaaacgtaacttgttataagcttgtttaaaggttaatgtaaacggtgacaaagggatgttgttttttgtgatgttttatcttattttagtatttctttactagtaatcaaagaggaggcttataaaatgatttcttggtggggagcattaataggattagcacttgcgatttttttgattttacgaaaactagatccagtatattcgctattattaggagccattgtcggcgccattattggtggggctggtttagaaggaactattaatattttggttaaaggtgagcaaagtgtaatgggaacggtccttcgagtattagcggcaggaatgttagctggcgttatgatggattctggggctgccgaaacccttgcacggacgatcgttaataaatttggtgatcggttagctatttttgcattagctcttgcaacgatggtaattacagctgtgggggtctttatcccagttgctgttttaattgttgcaccaattgcccttgaagttggtcgcaatatgcatatttcaaaattatctttattggttgccttatctggtggaggcaaggcaggtaacataatctcaccaaatgcaaatacaattgcagcggcaaagggatttggtcttgagctgagtcaagtaatgattgctgattttattcctgccgtaatcgctttaatagttacagttgttgtagctagaatgatccgcaaaaaaggtagggcagttttagaacaagatcttgaagatagtacaaaaacaatcaagcaaagtgatttgccaacgtttaaacaagccatcgttgctcctgttattgcaatagttttacttttattaggaccaattggaactatttgtcatttaccattattagcaaaggtaaatttagatgctacctatgttttgccatttgcagcaataataggtgctttagcaatgggaaaaggtgagaagattaaaagttatgctcagactggtgttagtcgaatgactggtgtagtaatgattttaattggtgcaggtgcaattggtgctactatcaccgcgtctactttcccagagttattaattgatcttattaaggcaagtcatgtgcctggtgtcttattagcaccactttctggtattctcatggctggagcaactgcttcaacttctacgggtgttattttagctactggttcttttgccaagtctattttaggatttggtgttgcaccacttgcagcggcggcaatggttcatactggggcgattgtcattgaccaattacctcaaggaaactatttccatgttacagcgaatgcaatgcatatggatattaaagaacgatcgcaaggtattttttatgaattcttagttgggggttccgcaatgttaaccgcaactatcttgtatggctttttgcatttactataaatgaaaggatgatcagtgatgaaatttgtaattgctccagattcatttaaaggcggattaacagcaaaagaagcagcaaatgtgatggcagaaggaatcaaaagagtgtttccgaatgccgagtatgctttagttccaatggctgatggaggagaggggactgttcaatccttagttgatgcgactaacggtcaaaaaatgattgctaaagtccacaacccattaaataaattagttaatgctgagtacggaatattaggtgatggggaaacggcagtgattgagatggcggcggcaagtggccttcaatttgttaataaggagactgcgaacccgcttattacaactacatatggtaccggcgagttaattaaggatgctcttgaccataacattaaaaaaataattattggaattggtggaagtgcaaccgttgatggcggagcggggatggcccaagcacttggagcacgtttattggatgctgataatcatgaaattggtttaggcggtggtgagttagcaagtttagagcaagtagattttggaggattagatcctcgcttaaaaaatgtagatattcagattgcatcagacgtaaccaacccattaacaggaaaaaatggggcagccccagtatttggcccgcaaaaaggagctgatgaagaaatggtgaacatcttggacaaaaatcttcatcattatgcccgaaaaatagttgcagctggtgggccagacgttgaacaaacggcaggtgcaggggcagccggtggtttaggagccgggttgatagcatttaccggtgcgacaatgaagcgaggagtagaattagtgattgaagcaactcaactacaaaaaaaggcagttggcgctgattatgtttttactggtgaaggaggaattgatttccagactaaatttggtaaaacgccatatggagtcgctaaggcaactaaagaggtggctccaactgctccggtaattgtgttggctggaaatattggtaaaggcgtaaatgatctatattcatccacggccattgatgcaatttttgcaactcctgaaggggctaaaccattaaaaacagcattagcagatgcacctattgatattgctcaaacagcggaaaacgttgcacgtttaattaaagtgagtcatgttagtaattaagaattaaaagaggggcctgtgacataagttaagttactttcataaaaagcaaatacgcagtacaacaataggcctctaacgtccggcaaaaccgagcgttagaggcctattgttgcttgcgggggctcgaaaacgaagtcacaagtgacttctgtctcgctccctctgctattttcacgaacaattgcaagataacgtagaactctagcttcgcgtcgtcacaaggctcacgtctgaacgataatcagcccgtgactccgccttagtttagccaaccgccttgtcgagaagactgttttctatgcactttttatagcaaattactggcttggcttagtcttataaagaccgtataatgaattggaagataatcaaggagaatttaaaaatggaagataataaatatcaatatgatgaaaacggctttcgggaagatctaaaagatgatccggatgttcttcaccagccagatgctgaccgtacacagcgcgatttaataactctggactatgatgagacgttggcatttcttaatggtgaaaaggaagttaagaccgtttatgacttttcagatgatgttttggaaaaaataaaagaaaaatatccaaccctaaatgatacaccgatcaataaagtaatcatggaaaagtatcagcagattttatccgcgcgatacaatgaatcacaagcaaataataagacggtgcataccgatgatagcgaggataatgatgaatagcttaataacgtttattatttcaattgcctttttaggattagtgatttgggaaaatcgtttgcatagtcaacttggatttttggcaagtcaacgaccagataaagttacgaaggattttatccgagtaattcgtcaagagaaacgcttgaattggatcttgtgtatcttagcaattatcgttttcatgacgactagtcgttactcagttctattaatgagtattattacaattattgaattgttattagtaactcgcatggatcgtgtaaaaaacgaaatgatagattaaatattattataatagttaatattttaagaaagagtaacgttttttaagaactatctaataattgctatacgcatttaaaaattaatggtaaagttagaattgtgtatttcactaatttattattatttgtttagtttttaggaacttattgggagggtgttttatttatatgagtaaaaaaagaacacatcattcaaataaccatcgatctcgtggcgtttttgcaggagcagttagtgccttaagtttattagcagtaacaacacaagcagttaatgctgaacagcttactgttaagtctggtgacactatttgggggcttgcaaaacaacatggactttctgttagtgcattagaacaagcaaatccttcagttaagaagataaacgatagcatcgacttaattacggttggtcaacaattaacgttgcctactgctcaacatgatgctagcgctgatttgaatgctgatggtagttatactgttaagcctggcgacacgcttagctctattgctgatcgttataatgtaacggttagtcaattaatggcatggaataacctaagcactaatgactcattatacattggacaacaactcagtgtaacagatcctgcgatctcaactgctgtaaacgcacccgctgtaagtgctcctgttgctcaatcgacagatgcaacttcatcggttcaggttcaaacttcagcagttgcctctgcttctgtgcctcaacgagatgtggctagtagccaaccagcaggaactgttcctagtcaaagtgctgccaatagcaacgcaactcttgcaaataacacagctacggttgcgactggctcctcagctgctaatagcgtagcaactgcaacagatgctgctcaaactactacagctaatactgcttctacctcagctgaaaatagtgttgcaccacaaacgcaaaacgttgcggttagtcaggctgcttcaacagctgtaaatacgactgctttatatggacaatcatttgttcaagcagcaccagtagcaagtcaagctccacaatcacagactgctccagcatcacaagcaacggttaacgttcagaacagtaatgctgctgcttcacaacaaacaactgctgtaacatcacaaactcaaccgcaacaatcacaagcggctgctagtcaacctgcacagcaagcagcaactactaatcaagatttacaacatggttctgtagttagtcttgccactaagatcgccaactctaatagtgttccgtacgtatggggtggtgaaagccttagtggaatggattgttctggattagttaagtatgtttatgctaatgcggaaggtaagcaattaccacactatacgggagcccttgaaaactgtgtggaccaacatccagttagtgaagctaagccaggtgatcttttgttctggggtaaccatggttcaacttaccatacagctatttatacaggaaataatcaatatgtagcagctgctcaccctggaactaatgtatcgacttacacgattagttcatactttaatccaagttttgccggaacagttaaatagttctgatagattattagagctttttcattagatagtaacaaagatgtaacctaaaaaagggttaacattcttctaagttcgtgttatcttacttatattgcaattccagtattgctctaaaaatatttcacatttattggggagtgttaaatatgagtaacaaacatgaaattgaagaagatttataccgtgcacagtcccgtttggatgatttatgtaaacaagaaggacaggaaaatacgggtacgcagactgttactattcaaccaaagtacggtgaagagatgcaatctttacgagaagaatgcagccagttacggattattttagaagccatggaagcttctgaagattaataaactaaaaaaattaacaaaaagcagtaagtgctagaagaaaaaattttttctgtgcttactgcttttaacttatttttctattgtttgccaaattggatattgactaatgtctaaggtgaggtcgataaaacgattaccaatctcttctccatcagtttgactaaattctagtgaagtagttgtgatgtggagattatcgctttggaagtggtgggcaaattttgattggtctaacttaccccgggctaactgtagcaattgccaaattgtcataggccaaccttttcgttcagcaacgactaattccaatgatggtttctttaatgaagcatttggtgcgaccttaaatccgccaccgataaatggatgattgctggtaattgcgatgtaagctttaggaaaaataaagcgttcacgcccagattgaatcatcaaggtaaagggctcttgatcatagattactccaattgccttttgaagataggtgaaacgcccgatatgatttttcttgtgatgagccttgaatgtattagcacgactaacaattgccgcgtcaaaaccaattcctaaattattaagaaaatagccttcttcaccccgaatcgcctcatgataatgaccaatgttaattttttgtggtgcgtctgcagttaaaatttgatttaatgccctttgtggatgcatagaaatcccgtaaccgcgggcaaaatcatttcctgtcccggcaggaatatatccaaccgcaagtggttctttattcaatcgcttggccgtcttcataagtccattaacaacttgatgtagcgtaccgtcaccaccaatcgcaatgacaattgttgatcccgcattatgggattgagcgatttgactggcaaggtattctccatgattaggatacttagttgtttccatgtgataatcaatttgttgttgatctaagaccggtttgattgacgaccatgccttttctgcattgccattaccagcatgacggttgaggatgattgaataattcatcaatattcctcctttgaatggtgccaaaaagcaaaaataatataattaatttagtatttttctaatgttcataagaaagttggaggctgagaaaaacaagcgtttttctcagcctctgttaatgattaaaagcttagaacgtcgtcaacttaaagttagggttttgcttttcgtaagcaagggccttttcatcaagttgttctacaaattcaatattgtagtcagtgttgtgttcaaccattaaaagtgcttcagcttctgaatcagcttcaatatacaatgattgagtattttcacgaactgggcgttttgtcttatcagcttggtagtatactttaaaagtcatactgttaaaaactccttaattaaagatattatgcagtaatttactttattattctatcacagatgaccaaaagtgtcttaaattttcctaacatggtattattaaataaaggtaaaggccaacgaggtgatagtcatggttatattcttaatctgtattttagcagcaataattgttattgccctttatttaacgatccatcgcgtatttcttaagcgagcaacgatgatggtacagaaaaatgctcaagatgttactgatgcagcgttaaatactagtttgaaagaaatgttacattggaataaaaatctgaattctcaaattgttgccgatgtttggggaaaaggtgtgcttgcttttgaataccattttgattataaaaaagaaaatattaatcttgatgatttcacacgtcaaaaactagcagcaaaacttgatgaatacgcaaaacaacatcagttaaagatggctcccaacgcttctcaaccgtttattataaccgattggtggaaatatgaggggattttgcatatcgatattgcctatttgataaatgaagcaactgttgagtacattgaagatttagaaaaattaaatcaaaatagtaattagttaaaatggccgggagaaagtgtggttttctctcgaccattttttgtaaaacttaactaatcatcactgtatctgcaggcgcctcaaatggttgatctttattaatatgatcgtaaaatagtaccccatgcaaatggtcaatttcatgctgacaaacaattgctgggtaatgctttaatcgtaccttatgcgtttcaccattaacgtcttgataacgtaatgtgatgcggtcatgtcgtggcacgtagccaggtacatctttgtcaactgaaagacaaccttcaccttcagtaagagcaccatattgaaccgattcactgacgattactggattaataataacgtccttaaataagggcttttcatcttcatcaggtgcaggaacaaggacagcagccatttgctttgaaacaccaacttgaggagcagcaaggccaacgccagctcgtaacttgtattttttacataattcaggatcttgacttacttctaagtatttcatcatatctttagctaatttttggtcttcatcagatagggggaatgagaccttagcagctcgtttacgtaaaacgggattgccgtcacgggtaatatctttcattaaatacattactcactatgcctccatataaaaattcagtcatattatagtctatcatatctagcaaaaattgctaattaagatatattttagttaaaaatagtatttttaagcgaaaacgtttaattttaatagaaaagaataacgtttttgtctattaagttaatgaaagcgcttgtattatttaggcaatcggttatactataaatgtaggtaagcaatcgcttacatgatgttaattggatttggaaaggaatgttgaatatggccaataccaaagctgtcaattttgctgagattaaagccaatgaaggggtaccttatgcaaaacctgtacaaattcttgataacgacggaaatgttgttaacaaagaattaatggctaatttcagtgatgaattattagttgacttaatgaaaaaaatggtttgggaacgtgccttgcatgaacaaacaatgagtttctcaaagcaaggtcggttaggtttttatgctccaacttggggtgaagaagcttctgaaatgggaaccgctgctgcatttaagaagcaagacttcctatttccggcataccgtgatttgccacaattaattcaacatggagcaactgttgctcaaatgtacttatggtcaaagggacacatcaaaggtaatctttttgatgcacgtgctctccggccacaaatcattattggtgctcagatggtcgaaatggctggtggtgctcttggaattaagaagaatggtgagaaagacactgttgcctatgcttacactggtgaaggcggaagttcacaaggggatacttatgaaggaatgaactttgctggtgcattccaagtacctggtgtatttattattcaaaataatggatgggctatttcgttcccacgaaagctccaaactgaagcacaaacaattgcccaaaaggctgttgctgctggaattccaggtgttcaagttgatggaatggacgtccttgcatgttatgaagttgcaaaggaagctcgtgaatttgctgctgccggtaatggaccagtgctaatcgaaacattaacataccggttcggtgctcacagttcagcaggtgatgatcctactcgttaccggactgaggatgaaacaaagccatggtttgataaagatccattgattcgtcttcgcaagtacctaacgaaaaaggggctttggtctgaagaagaagaacaaaaatatgctgatgaatgcaaacaaagctttaaagaagcaatgaaagaagctgactcagtagaacctgaaaaagttagcgatatgttgaaacggacgtttgaagtaccaactccagacattaaagaacaaattaagaagtacgaagaaaaggagtcgaagtaatcatggctaaaaagacttatatcaaagctattactgaaggtattgacatcgctttagccgaagatcctaagactttagtattcggtgaagatgttggtaaaaacggtggtgttttccgtgctactaatgggcttcaagaaaaatacggtgttgatcgagtatttagtacccctcttgccgaatcaggtattttaggaatgtcaattggtttagtagcaaccggctggcgtccagtcccagaaattcaattcatgggtttcacctttgaagcaatggattctatcgctgcccaaatgtcacggatgcgtttccaatataatggaactaagcatgcgccaattaccattcggactccttatggtggtggtactcatactgctgaattgcacggggatgatcttgaaaacttcttcgttggtattccaggattacgggttgttgcaccaagttctgcctatgatgctaagggattaattatttctgcaattgaaaataacgatccagttcttttccttgaaaaccttcgtctctatcgttcagtcaaaggtgaagttcctgatgacaagtatactgttccgttggataaagcaaatgttgttcaagaaggtactgatgttacaattatcgcttatggtggtgaagtatcagaagcgcaaaaagctgctaagaaattagctaaggataatatttctgctgagattatcgacttacgttctctttacccgcttgatactgacacgatctttgaatcacttaagaagacgcaccgagtagttattgttcaagaagcgcaaaagatggctggtgttggtgcccaagttgcatcagctatttcagaaggcgcaattatgtaccttgatgctcctgttacccgggttgctgctcctaactcagtatatccattcccacaagctgaaaatgtttggcttccaggtgcacgtgatattgaggatgccgtacgggaagtaattaattactaaaagtacggaatagaaagggtgttaatacgatatggcatacatttttagactaccagaaatgggagaaggattaactgaaggtgatgttgcttcttggctcattaaagaaggagaagcaattaaagctgatgatcctttaattgaaattcaaactgataaatcaactactcaattggtatctccagttgatggaactgtcaaaaaattatttgtaaaagaagacgaccatgttgaaaaaggcgacaagctcgctgaaattgatgatggtaagcctggtattagtacaaacgtcgaaagtgaagacgatgatgatgaaactgatacaggcagtgaagaagctactgaaagtgaagaatccacggctccagctgcagattccccttcagaagataattcttcaaaaggtagagtagccccacttgcagaaccaaataagcttgtaatggcaatgccttctgttcgtcaatatgcccgtgataagggtgttgatatttcacttgttcaaccaagtggtaaccacggtcaagttcttaaagaggatattgataactttaatggggcagctgctccagctaaggaagaaaagagtgcggctacgtcagctaagactgctcctgttgcggctaagaccgctggtaatacaatcaagccatggaatgctgaccttgaagaacgtgaaccaatgtctaatatgcggaagattatcgctaagactactcgtgaatcaaaggatatctcaccacatgttacatcatttgatgaagttgaagtatctgctctaatggctagtcgcaagaagtacaaggcagttgctgcagaacaagatattcacttgactttcttgccatacattgttaaggccttagttgccacatgcaagaagttcccagaactaaatgcttcaattgatgattctactcaagaaattgtttacaagcactactacaatgttgggatccttacaaacactgaccacggtctctataatccaaatattaagaatgcagattctaagagcatgtttgagattgcaaaagaaattactgaaaatactcaggcagcctttgataacaagctaagtccagaatcaatggctggtcggactatcagtatcagtaatattggttcaattggcggtggctggttcacccctgttatcaaccaaccagatgttgctattcttggtgttggtcgaattgacaaggaaccatacgttaacgaagatggtgaaattgttgttggtcgaatgatgaagttatcattgacttacgatcaccgtttaattgatggtggacttgcacaacatgcattgaactacatgaacaagttattacatgatccagaattattgatgatggagggctagataatggctgatgttgaacaaaaggatacagtaattgttggtggaggtcctggtggttatgtagccgctattcgagcttcagaattaggtcaaaaggttaccttaattgataagggagaaccaggtttaggtggtgtttgtttaaacgttggatgtgtgccatctaaagcattaattgctgctgggcaccgttaccaagaaactttagactcatctatttatggtatttctaagaccgatgcaaagttagactttactaagactcaagaatggaaagaccataaagttgtcgaccgtatgattcgtggagttaagatgctattgaagaagcataaggttgaaatcattgatggagaggcaattcttgataatgaccaccaacttcgtgtaattaagcctggtccaaagcaattcatggataatgataatggtcggactatcacatggaagaatttgattcttgcaacaggaagccgtccagtagaaattcctcattttaagtttgaaggccgcgttattgattcaaccggtggcttaaaccttaaggaagtaccagaagaattagttgtaattggtgggggctacattggtacagaattagctggtgcctatgccgatcttggtgctcatgtaacaattattgaaggtactgattcaattcttggtggatttgaccacgatatggttgatattgttgtcaagaatcttgaaaagaagggcgtagacattgtaactaaggcaatggctaaagattctcagcaagatgaaaatagtgttactgtcacttatgaagttgatggtagcgaaaagagcattaaagcagactactgcatggtatctgttggtcgtaaaccaaatactgatgattttggccttgatatgacaaatgttaagttaaacgaccgccatcaagtaattgttgatgaacaaggccggacgaatgtacctggtatttgggctattggagatattgttcctggtcctgcacttgctcacaaggcattctttgaagctaagactgctgctggtgcaattgctggtaagaatactgctaacgattgggttggagtgccaatggtttgttttgctgatccagaattagctcaagttggtatgacggttgaagaagctaaagataaaggaattgatgtatctactgctcagttcccatttgccggtaatgcccgtgctgtttctcttgacgctgccgaaggatttattcgcttaatctacactaaagataagaaaaatgttattggtgctcaaggtgtcggccctggtgttagtgaccttgctggtgaactttcattgattgtcaattgtggaatgaatgttgaagacgttgctttaacaatccatccacacccaactttgaatgaacctgttcaagaagctgcagacattgcgcttggcttcccaacacacatctaaattttagtaaattaaattagaaaagttcttagtgatggatgactcgattttgagatcgctaagaactttttctgtttgtattcttttaggccttttattcctaaatttccgtttggattgtataatacaagtaggaaatgaatggagggacaaaaaatgaattcacaaaactatagttatccgcttgatctatcatggacaactaaagagatggaaacagtaattgccatgtttagggcggttgaagatgcttatgaagttgggattgacagagataaaattttagattgttatcgtgcttttaagcaagtcgttccctcaaaggctgaagagaaacaattgggtcgcgagtttgaaaagaattcgggttatgttctctaccgtgttgtcaaagcagcacaagagtcaacagataagcgaattaaaatggttgggcaaaaaaatgattagtattgaagagttagatcaaaaagcacaacaaataatccgtcaagcaggtcaaaatgcataccagaaaatggaaaacgattaccaggttgatacgaagacgaattatacggaccttgtaacgacaattgaccgagaaaatgaacaattaataaatgatcaactgcgaaaaattgatcctgatagtcaaattttaagtgaagaaggatttggcgaccagcaaataagcaatatgcaaggacatgtttggattgttgatccaattgatggaacaatgaattttgttaagcagcataataattttgctgttatgttagcattgtatgttgacggtcaaccaacgcttggctatattttagatgtaattaataatcgtctttaccatggtcgcaagggtgctggtgtttatgctaacaaccaaaaaattagccagccagctgatttaggcttacgcgaaagtttgttagcaatgaatcggatattaactttaagtggcgattcagcattaaagaaaatcgctcaagacgcaattggcttacggatgtatggaagtgctggtattgagatgattggtgtgatcactggtcaattaggtggatatatctcgaatttgaagccatgggaccttgctgccgggcgaatgttagcagaagaattaggcttagttgtgaaatcaattgacggtagttctattaatgtgttatcatctaatcttgtattagtagcaacgaggcaggttagtcgagatattcgacagatcatcaattagttgtcgaggctgtgaccgcgatgtcacagtttttttatgaaattggcaattgataggccgctgctgttcgacttaaaaatgatatgacgaaagggagaatcaagttttgaaaactcgtgacgacattcgtaacattgcgattattgcccacgttgaccacggtaagactaccttagttaacgaaatgttgaagcaatcagatactttaccagaacacttctcaattgaagatcgtgcgatggatactaacgctattgagcgtgaacgtggtattactattctttcgaaaaatactgctgttaaatatgacaatcaccaaattaacatcttggatacaccaggacacgcggacttcggtggtgaagttgaacgtgttatgaagatggttgatggtgtattacttgttgtggatgctttcgaagggacgatgcctcagacacggttcgttcttaagaaggctcttgaacaacacttaacaccaattgttgtgattaacaaggttgaccgtaaaggtgctcgtcctgaagaagttgttgatgaagttcttgacctctttatcgaattaggtgctgatgaagatcaacttgacttcccagttgtttacacttcagcaatgaacggtacttcaagttatgattcagatgtttctactcaagaacacaccatgaagccattgtttgatactattatcaagacaattcctgctccagtagacaattctgatgaaccacttcaattccaagttgctatcttagattacaatgacttcgttggtcgaattggtatcggtcgtgtcttccgtggtaagattaaggtcggagataatgttaccttaatgaagcttgatggctcaaagaagaatttccgggttactaagctctttggtttcttcggtttgaagcggttggaaattaatgaagctgaagccggtgacttaattgcggtttctgggatggaagacatcaacgttggtgaaactgtagctgatgcagaacaccccgaagcaattactccattacggattgatccacctacattacaaatgactttccggaccaacgattctccatttgctggtcgtgaaggtaaatttgttactgcccgtcagcttgaagatcgtttgaagcgtgaaatgcaaactgatgtgtcattaaaggttgaagatactgatgacccaggtgcatggactgtttcaggtcgtggagaattacacctttctatcttgatcgaaactttacgtcgtgaaggatatgaattatctgtatcacgtccacaagttatttaccgtgaaattgatggagtaatgagtgaaccatttgaagaagttcaaatcgatactccagatgaatacactggtgcagttattgatagcctttctaaacgtaagggtgaaatgaagaacatggaaccaggcgaaaatggtcaaactcgtcttatcttcttagcaccatcacgtggtttgattggatactcaactgaatttatgactatgacccgtggctacggaatcatgagccatacctttgaaaaatacgcaccagttatcaagaactggaaccctggtcgtcaaaaaggtactcttgtatccatgaatgctggtaaggctactacttacgcaatgatgggtatcgaaagtcgtggtcaattattaattgatccaggtacggaagtttacgaaggtatgatcgttggtgaaaacagtcgtgaaaatgatattactgttaacatcaccaagggtaagaacttaacgaacgttcgtgctgctggttctgatgaaatggctcacattaagacccctactcacttctcccttgaagaatcgcttgaattcttaaatgaagatgaatactgtgaagtaactccagaaaatatccgtttacggaagaagacccttaacacaaatgcccgtgaaaaggaagctaagcgtcgtcgtgctgcttcacggaagtaaatatttaaaaaagcttgggaggctaactagctttccgagcttttttttgttgtataataatgattgtattttgtttttaggtaggtgcactttgtgaagaaaaagaaattaagattccgtaagattcgttctgtatggaataacgtccgctaccttgattattatattttagttccttatcttgctttatgtttagtaggaattgtaatggtctattcagctagtgcttccattgaaatgcaaaatggtggaaccccattaggatatttagtaaaacaaacaatttatgttgtaatgggagttgcagtaatggcatttatggcaaattatcctttgcggcattatcgaacgccaaggtttttgcgggattcaacattggtggttggtgctttacttgtcattgttttagtctttagccgagctgttaacggagctaaaggttggatatctttaggcttctttaatattcaaccggtggaaatttgtaagctatattttatcttatatttagctgatcgaatggctaaaattaggcaacggggacaacattttaccactgatgctaaaggtccttggctcataattgtagtctttctcggattgattatgattcaaccagatattggaggaatggcgattaacggagcgattattgcaatcatgcttttagcggcggattataaatggggcgttggtttggggataattcttgttttaccagcgcttggctaccttggattggaacgactagttgaaagtggtttgctccaaggcggtggataccaagttgcgcgttttgttgcctttctaaatccttttggaaatgctagtggttcaggaagccaattagttaattcctattacgcaatcagtaatggtggtgtatttggggtaggacttggaaacagtatccagaaaatgggatatttgccagaacccaataccgactttattatgtcgattactagtgaagaattgggcctagttggggtaacggcaattttggttactttactctttttgatttgtcgtattattcaagttggggtgcgggcagatagtttgtatcaaacgctcatctgttatggttcagcaacattttttacgattgaaacactctttaatattggtggagttctaggactcttgccgattacgggggttaccttcccatttattagttatgggggatcaagtatgttgattctttctgcaacggtaggcattataatgaatattagtatgcagcaaaaccgtgatcgcttggttatgggaaaaccgtttgttcctgaaacaggaggcgtaaagaatgtttaaattaattccacgccgttccttgataatttacattaataataatcgtgtgattcgagctcttcgtcattatggtcaggttgattatatttctcgccgaatgcattatgtggtaatgtatgtagaccaaagtgatgtcgaaaaaataaaagagaagataggtcgattacgcgcagtgaaaaaggttgaattatcagctcggccagatttagacccgacgttagctgatcttgaattaacgggggtctatcaattacatgatgaggatgataaaaaatgagaattgttgcaggagactttgggggacgaaagctaagtgctgttccgggaatggcaacgcgtccaacaactgataaagttaaagaagcattatttaatataatcggtccttactttaatggcggaaccagtctagatttgtttgccggaagcggtggattaagtattgaagctgtatcacgcggaatcagtcaggcagtcctagttgatcgtcaatatcaagcaatcaaaacaattaagaagaatattgacgttacaaaacatgttgaacaatttaaagtttataaaatggacgctcataaagcattaaatttgtttgcaaaagacaagatgaaatttaacttggtctttttagatccgccctatgctaaacagcaaattgttaatgatattgagcagatggttaaaaataatttactagctaaagatgcaataattgtggcagaaacagatcagaatgcgaaattgccaacagatttagctgattttaactttattcgccgtcaagaatatggaattacggttttaacaatttatcaatatgaaggagaatcaaaataatgaaagttgcagtttttcctggatcatttgacccattaacacttggacatttagatttaattaaacgaggaagtgcattatttgatcaattggcagtagcggtaatgactaatgaaagtaaaaacccgctgtttactgttgaagaacgagtagcgcaaattaaagaggcagttagcggactagataatgtttcggttattacaacagagggcttaactgttgatctaatgaaccgcattggggcagattacttaatgcgtggtttgcgtaatactactgattttcaatatgaacgtgatattgcggcgatgaataactttttagatgatcagtgtgagaccgtctttttccttgccaagcctgaatatcagcacttatctagtagtttgctaaaagaagtaacatcggctgggggagatatctcagcttatcttcctgctaatattaatgaagcactaaaaaagcgtttaatggaacgagaaatgttacgggttaagaaagacaatgaaaaagcaagataatgtaatattacgacgaataggaattattttagggcttgtccttttactaggctgctttttgttctggcccctaaattcctatatcgaaagtccgggaacggcagctgatttacagtcttttgttaaaataaagagacaccccgatcgatataaggggagttttatgttgacatcggtggcgattcaacgcgcccatcctgcaacatatttatatgccaaaatgatgccctatatgtcaatcgagagtgcagaggatgtaactggcggtcaaaatagtgcaacgtatgaccgtgtccaaaaattttatatggatagctcaattaacgaggcaattgcagttgcttacaatgccgctcaccaaaaagtaacgcgacgctatctaggaatttatgtattgcaagttcagcctaattctaaattcaaacatgatattcatgttggggatacaattacaaaagtagatggtcatcactttaataccgctcaaggctttcaaaaatatattggtgctaaaaaagttggcactccgttagcggttacttatactcgagatgggaaaactaaaactgtcactcatccgcttgttaaaattgctaatactaataagccgggaattgggatcatccttactaacaatatgcaagttaagactaagatcccagtaaaggttgatgctggtcaatacggtgggccatccggtggcttaatgttcagtttacaaatatatcaacaaattagtggaaaagatttgcaacggggacgtaaaattgccggaactggaacgataaattcagacgggaccgttggagaaattggtggaattgacaagaaagtaatcgccgcgcaccgtgcaggagccactattttctttgccccttatataaaaccaacgaaagagattcttaagtatgaagaaggtcatctgactaattatcaaatggctaaaaaagcagctaaaaaatatgcaccgggaatgaaggttgtcccagtcacttcctttgatgacgcggtgaaatatttacaaacgcataagtaaattaaaaagcaagaggcaaaataaaggtctcttgctttttttaatgcaaaattgatttttttacgtatttatatttatagggaggtgagaaacatgcagcaattatcagaattatggataaaatatcgagtacaagtgctgatgatagtgattgctgcagtggttgggggatattggatacttaataaaaacaataacgatgctttaatttcaaatactaatgctgttttaacaagtagcgaaacgggaagcagtttaacttctaccactacgatgaaagggaccgttgccattgatataaaaggtgccgtaaaaatgcccggagtttatgagttgaaagcagatgatcgtgtgaacgaagccttgaaggcggcaggtggaccactacccagtgcagatttgcgtcaagtgaatcttgctaaacaattaacagatcagcaaatgatctatattccgcttcaaggcgaaacgccggtagcttccagcagtacagaaccatcagcagctaataatgaaaatggcaacgataattctgcaaagataaatctaaatacggcaaccaaagaacaactatgtcaaataacgggaattggcgataaaaaagcagacttgatattacaataccgacaagaacacggtcagtttaagagtattgacgaacttaaagaaataaatggctttggcgaaaaaactgttgctaaactaaaagatcacctatctatctagtttttatttttttgatgaagatatttgttatactatatttcaaatatagaggagtgaaataatatgaaaccgagaattgattgggaccagtattttatgattcaagcagctttattggcgtcgcgaagtacctgcaaccgcctttcagtaggtgcagttttagttcgtgataagcggataattgctggtgggtacaatggctcagtcgctggtgatgcacattgtattgatgaaggctgttatttacgtgatggacattgtgtgcgaactattcatgcagaaatgaatgctcttttacagtgtgctaagtttggtatttctgctgatggggcaagcatttatgtaacagattttccttgtttacaatgtaccaaaagtttattgcagactggaattaaggagataaattatattcgtaattatcacaatgatgattatgcaatgaaattacttaaactaaaaaatgttgcgcttcatcagattaaattagatagtgatattttagaagaggtcgatctggaccagtatatcaacccagatcaaaaatagattattcaacacttttggtttttccccgcgctaattgcaagtttagtagcagttagtttctttagttcatattggttaatttttcttttaattgctatattttaccgaattgccgtattaaaaaggccaatagtacttgggattggagtgctgacatgtttattaatggcgattttgtgttacagtttacaaaaaaattgggcaactattacggcagataagcaaatggaagttacccaaagaatattagtttaccctgatgaattaaaatttaatggaaattttatgacagggactgcgatcgacattcaaactggacaacgcgaagcaataacgatgtcgtttaagtcaccccagatgctaaaaaatattgataagcttacaacaccctcgatatggcttattaatgggcagttaaaaccgattattccccgtacaaatgaaaatcaatttgataacttaacttataaccatcatcgtcggatctgtaatcaagttcaaattaaccgggtagagcaaatagttaggcaaaaaagagggatagttggctggtgtcatacattaagaaaacgactcagcctctacttcgaaactttaccgcctcctcttagtgcatattgccaacaattaataattggtagtagtaatgaggattcggctgaattaatggtaagtatcaaaaggcttggcctgcttcaccttttttgcatttcaggaatgcatatcgtacttttcactgatttattacggcgactattggttcatttatggtggcgtaaagaatcgattgatttattcttaattattattttgccgttttatcttctcattggtggtggagcaacaagcttgataagagcaaccattatggctgaacttggccttcttcatcgatatttaaatttggaccgtcttgatgggtgggcgctgagcttattaattggattggttattgatccgttgctattgcttacattaggcggtcaattaagctatttgctttcttttattcttcaagttcttccagaatcagtacgtggttttaaacagtctttattattgaatttaattagtttgccttcgttattgagttatgtatatgaggttcatcttctaagctttggggttagttatttaataattccgctattttctacaattgtttttccagcggtcttggttggggcacttagttttaagctttttgaaccactcacgtatctaattaatgctggtttaaaatgctttcaatatattttaaattggttatctgattttccaggaatgattcattttgggaaaccaccgttaattttggcccttctattatttgcggcatctttatttgttatttctcaagatacatctttaaaatcatggaagatattagccttattgtatgtaattactggagggataattcatttgccacttaatggcgaagttacctttgttgatattggacagggggactcgataattattagagaaccttttaatcgacgggtaacaatgattgatacaggaggcaaattaaattttaaaaagccggattgggcgacttcaaagcattctcaagatgatgcccaacgaataactattaattatttgaaaagtaaaggcattaggcaaattgataatatttgtttaactcaccatgatgcagatcatatcggctatttaacaacgattttagataatatagcagtgaaaagattgattgtctcagcggggatggaaagacaaccagcacttcttaataaagtaaggactgctgaaaagtcatcgccaatgataattccggtgactgataatgttaagttgtcatcatttccattgcaaattctacatccttttgttccgggtgaagggaaaaatgaagattctttagtgttagctgggaaatttggtgggaaaagattcctttttactggggatttggaccaggaaaatgaagaaaaagttattcaaaagtatccgcaactaaagtcagatatcttaaaagctggtcatcatggcagtaaaactgctagtagttatttatttttgcagacagttgctcctaagtatgcgataatttcagctggacgatttaataggtatcgccatcctgatgaaataacaataaaaaattttcaaagattaaatattaattacttatcaacgcagcaatttggaatgatacaatatgtataccatggtcgaaatggaaaaataaaaacaacattgaggggagatgagacaagttggacattgcccaattatctacacaattaaaaactaaaaccccagcaatggtatatttgattttaggaaaacaacaggttcttcaacagcaggcaattgatgcctttacaagccttattccagagaatgaacaggtcatgaatgttggtcgatatgatatggaagccacgccgttggcagttgctttggatgatgcgatggcgactccattttttggtgaacgacgattagttattatcaataaaccgttcttcttaactggtgagaaaaggcattcgaaagttgagcatgatttggatagcttaaaaaagtatcttgaacaccctgaaccgtctacaattttagtttttacggccccttatgaaaagcttgatggacgaaaagggattgtaaagcaattaaagaagacagcagttttagttgatgctagtccacttgatgaacgagcagctcgtcaaagagtgagaactcaattatcaactgctgggtttgaaatatcagaagctgctttggatgagttggttcaacggactaatgcggattatgggatgatggatgcaagcttaactaaattaaagattttggcttatcatgaaaaaaagattgatcaaaacatggtagccgctttagttccgcaatcattagatgaaaatgtatttgatttagtcactgcggttcttaagcataatcaaataaaggccttagatctctatcaacagctattagcaggtcagcaaccaccgttaaggattaatgcggtgctagtggggcagtttcggttgttgattcaaataaaagtattaagcaaacgcggccttacgcaagggagtctagcaagtcaacttaatgtccatccttatcgaattaaattgggattaaagactgcacgtgatttctcaatgcaggcgttagaaaatgcctatttgggattaattcgtattgaacaatcgttaaaaacgacacagcgcgatccatcacttttatttcagttatttatgttacagtattctcagcagagcaaaggggcatgagatacaaaaagaggataagaaaacaaaatttcttatcctctttttgtgaaaagttaaaaataaaaaagcaactaacttaatagttgctttttcattacttagcgtaacgtgctgagagacgtgacttgtcacgtgcagccttgttagccttgataaggcccttagagtgggcacggtcaattgctgagatagcagccttgtataagtcgtcaaggttatctgcgccagcaagctttgccttatcgaacttcttaatagcagtccgcatttggcttaattgtgaagcgttacgtgcttcagctttttcactagtacgaacacgttcaattgctgatttgataattggcatgagtttcacctccgttacccgattttcagttgaccagaattttcaacatttgtcattatacaaaagactagcgagcaatgcaatagctaacgacgatcaagtcaaaatttcacagaaatagttgcaacattggtaaattttatgtatatttgtataggttacttcaagcaagtaattaattgcctcttctcagtttaacgatcctcaccgacgttatacttagatcttaggcgcattaatattgaaaggtgggaaaatagcatggctatttcaaaagaacgtaaagatcaaattattaaggaattcgcaactcacgaaggagacactggttctactcaagttcaagttgctgttttaactgctgacatcaacgaattgaacgatcaccttcgtacacacaagcacgattaccattcacaacgtggtttaatgaagaagattggtcaccgtcgtaacttattagcttacttacgtcggactgatttacctgcttaccgtgaacttatccaaaagttaggtttacgtcggtaatattttattatcaaagcactttgccttttacttggaggcaaggtgttttttgtttttactccattattttcactgattgtggtaagatatttataactataatgaacgatataaaattcttatcgctacacattgtaatcgataaggggttcaaaactaaatattaaaggagccaaatcaatggataataatattaaaattattccttttggtggtgtacgcgaaaatggtaaaaatatgtacgccgttgagattgaagaccaaattttcattttggatacggggttaaagtatccggaaaatgaattaatgggaatcgatgttgtcattcctgactgggaataccttcgtgaacataaggacaagatagtcggagtattcttaacacatggacatgcagattcaattggggcacttccgtatttcttgatggactttaatgttccggtatttggaagcgagatgacgattgccttagcaaaactggcagttaaaaaccataaggaagttaagaaatttaatgattttcatgttgttgatgcttcaacagcaattgattttaatgatgttacagtttcgttcttccaaacgacccatactattcctgaaactttaggggttgttttagaaactaaagcaggaaatattgtttacactggtgattttaaattcgatcagacagctaaaaaaggttatcaaacagaccttgctcgtttagcagaaattggatcacaaggtgtattagcacttttaagtgattctgctggtgctggaattacgggtgcgtctgctcgtgagcaagatattggagactacattaaagaaacatttaaatatcaaaacggtcggattattgttgctagtgtagcttcaaatattatgcgcgtacagcagattatcaatgctgctgttgccgttggtcggaagattgttttatctggtaaagatattgagcaaatcatcgatacagcaatgtctttgggaaagctgcacttaccagatgacttattcattagtcgcaaggaagcagaaaaacttgaaccaaatcaagttgttattttggaaactggtaaaatgggcgaaccgattaagtcattacagcaaattgcaaacggtgataatcctaatttacaattaacgagtaccgatcttgtctttgttactactactccttcttatgcgcaggagactgaggtacaaaagacaaaagatatgatttatcgtacgggagcagaagttaagtttatttctgatgatttgaatccttctgggcatgctaaccaaaatgatgaacagttaatgttgaacttcatgaaacccaagttcttcattccaattcaaggcgaataccgtctgttagatcgtcatgcagaattagcagaagaagtaggaattccaaaagaaaatatcttcctcgttaataagggtgatgttctaacctacaaaaatggtaaattccatgttggagaacatattgatgtaagcaatactatgattgacgggacaggtgtcggtgatatcggtaatattgttttacgagatcggcgcgtcctatcagaggatgggatttttgttgtggtggcaactattgatcggaaaaagaaaaagatcgttgctcgaccacaaattacgtcacgaggattcgtgtttgtaaagactaaccgtcaactaatgcaacagagtgctgacttagttgaaaagattgttcaagaaaatctagatcaaaaggaatttgattggagtcacttgaaacaagatgttcgcgataaattaaaccgattcttgtttgatcaaactaaacggcatccagttattttgccagttattatggagattaatcaacaccaaaagaagattaaaaacaatgttgagaagaaagaagagaaatctgcaaagtcacgttcaacgaaagaacatcatcgtggtcgtggtaaaaaacgaatggcaaaagaaaagaagtagctgtttaatataaataatgtgaagggaggctgggagaaaactttcgtttttctcccagcctcaactgcttttatgaataattgtataaagtaatgaaataaaaaagggtgataaaaatgaacgaaacccaacaagatcaatatctccaggctcaaaaattaattgctgaagaaaaatggcaagaagctagtaatattctggaagatcttataaacgaggttgatgattcagaaatcggtcgattgacgatcatcgctctgtatcattctcaacaatataccagggcttgtacttacttgtttgagtatttagaagtaatgtttgatagcttggcagatgctcaaattgccattaaaattttatgtcaaaatgaattatttgttttagcaagacaggtgattagtagtctttcgcaatggcaggaagatttgttgacaattgttacaatgggtgagaaaaaatctcgtcaagagtaccaggagacattacaaacacgtttgcgagacttttatcatttaggagattactcccttgaagagcagcaaagtaggctgcaggcggcttttaagcttcctttaaatgaatttattacaggcgctaaattcctgcttcgtgacccctatactcatccactggtaaagtctagtttggttgagctacttagtaagttacaagttgcagatccagttactgtttattggctagataagaaagaatatacagttgtgccagccgatattcagcctttaaatttattgccaatcgttagtgaaggtaagagattaattacagaaaagtgtggaaatcaaaacccgcagacagaaaagctggcaattcaagaatttcaattacaggtaatgtttttgtatccgcgaattaatcaaattattgaggacattgatgaatggacaaacgttttaatcgcaagaatagaaggaaagaaagtcgcaacaaatacagtttctaatacctggcagaaacgattaggtaagcagattgacgaattaatagaaaaacattagtcaaatacatttacaaatgaacagatagttgatattatatttaagaattcttcttcagagcctaagattaaagctttcaattggcgaaaagaagttgtacaatatgtataagggtatgtcagtcaccgaatcagatgatctggcattatacttgtaaattatcaggaggttttcattaatggctgaaaaagaacattatgaacgtacaaaaccccacgttaacattggtactattggccacgttgaccacgggaagactactttaactgctgctattacaaaggtattggcagccaaaggtttagcaaaggcagaagattacgctgatatcgatgctgctccagaagaaaaggaacgtggtatcactatcaacactgcccacgttgaatacgaaactgaaaagcgtcactacgcacacatcgatgcccctggacacgctgactacgttaagaacatgatcactggtgctgcccaaatggatggtgctatccttgttgttgccgctactgatggtcctatgccacaaactcgtgaacacattcttcttgctcgtcaggttggtgttcaatacatcgttgtattcttgaacaagactgacttagttgacgatgatgaattagttgacttagttgaaatggaagttcgtgacttacttagcgaatacgatttccctggtgacgatgttccagttgttcgtggatctgctcttaaggcacttgaaggtgacccagaacaagaaaaagttatccttcacttaatggatgttattgatgactacattccaactccaaagcgtcctactgacaagccattcatgatgcctgtcgaagacgtatttactatcactggtcgtggtactgttgcttctggtcgtattgaccgtggtactgttaaggtcggtgacgaagttgaaatcgttggtttaactgaagacgttcttaagtcaactgttactggtttggaaatgttccacaagactcttgatcttggtgaagccggtgataacgttggtgtacttcttcgtggtatttcacacgaccaaatccaacgtggtcaagttttggctgaaccaggttcaatccaaactcacaagaacttcaagggtgaagtttacgttatgactaaggaagaagggggacgtcacactccattcttctcaaactaccgtccacaattctacttccacacaactgatgttactggtactatcgaattaccagatggtgtagaaatggttatgcctggtgataacgttacattcactgttaacttacaaaagccagttgctcttgaaaagggtcttaagttcactattcgtgaaggtggacacactgttggtgccggtgttgtatccgacatcttagactaatttttgagtacagatgtgctaaaaggcttggggaaacccaggtcttttttctttaacaaaaatatttgaaaataacttggggatcagccgtcaataagttgcaattactggtctcctacggtaaactaatatagtatgtaaagactaattataaatattaattagtcaaattgatttgttattggaggaaataaaatgtcagcaaaatgggaacgcgatagcgatgccagcaaaggtacattgacatttgaaattgatgtcgacactattaacaagggaattgacgaagctttcgttgagactcgtaaaaagatcactgttccgggtttccggaagggtcgtgtccctcgtcaaatctttaaccaaatgtacggtgaagaatcattgtatcaagatgccttaaacaaggtattacctgatgcatataatgaagcagtaaaagaaactaacattcaacctgtagatcaacctaagattgatattaagagcatggaaaagggtcaaccatgggtattaactgctgaagttgacgttatgccagaagttaaattaggtgaatacaagggtatggaagttcctgctcaagacaccactgttactgatgctgatgttgatgatgcacttgaaactaagcgtcaacaacaagctgaacttgtattaaaagaagataagccagccgaaaagggtgacactgttgttattgattacaagggtagcgttgacggtgaagaatttgatggcggttcagctgaaaactactcactagaattaggctcaggctcatttattccaggttttgaagatcaattaatcggtcacaacgctgatgaagatgttgatgtaaatgttaccttcccagaagattaccacgctaagaatcttgctggcaaggatgcacttttcaaggttaagattcacgaaatcaaggaaaagcaattaccagaacttgacgatgatttcgctaaggatgttgacgaagatgttgatactttagctgaattaaaggaaaagactaagaagcaacttcaagaagaaaaggataaccaagctaaggctgctattgaagatgctgctatcaataaggctgttgctaatgcagaaatccaagatattccacaagcaatgttggatgatgacactaaccgtcaaatgcaacaatacttagcaggaatgcaacaacaaggtatcagtcctcaaatgtacttccaaattactggtacaaaggaagaagatttgaagaagcaatttgctaatgatgctgctcaacgtgtaaagactaaccttgtcttagaagcaattgttgacgatgctaacttagatgctactgatgaagaaattgctaaagaaatttctgaccttgcaaagcaatacggtatggaagaagatgctgttaagaaggcattatctaaagacatgttaatgcatgatattaagatccgtaaggctgttgacttagttgctgattcagcaaagcaagttaaggatgacgaaaagtctgacaagtaatttgttaaataattactaatcaatgaggctggaagaaaacagtagttttcttccagcctcgctatttatcaaatattagtaagataaagtagaaaataatttactgagtaatttagtcgaaattaaacagtaattttgttattatgttttaataagtcttagaggaggttcatttatgtttgaagataccactggtatggattcagttcactgttcattttgtggaaagtcccaagatgaagtgaaaaaaattgttgctggtcctggcgtctatatttgtaacgaatgtgttgacctttgtaaacaaattattgatcaggaattagcagaagatgaagctaaaaaagctttccgtgtgccaactccaggagagattgttaacgaactggatgactatgtaattggtcaaggtgatgctaaaaaaacattagcagttgctgtttataaccactataagcgggttaatgcaatgatgagtggtgataataatgatacagaacttcaaaagagcaacattgccgtaattggtccaactggttctgggaaaacctatcttgcccagtcacttgcccgcattctcaatgttccatttgcgattgcagatgctacaactttaactgaagctggatacgttggtgaagatgttgagaatattatccttaaactacttcaggctgctgactttgatgtagaacgtgctgaaaaaggaatcatttacattgacgaaattgataaaatcgcaaagaagagtgaaaatgtatcaattacacgtgatgtttctggagaaggggttcaacaagctcttttaaagattcttgaaggaacaattgctaatgtaccgcctcagggaggacgtaagcatccacagcaagaatttatccaagtcgatacaaagaatatcctctttattgtggggggagcctttgatgggatcgaaacaattgttaaggaacgacttggtgataagacaattggatttggaacagactcacgagaagctgaagaggttacggataaaaatattttgcaacatgttattccagaagaccttcttaagtttggcttgattccagaatttatcggacgattacctgtgatgactgctcttgaaaaacttgatgaagatgaccttgttcgaatccttactgagccgaagaatgcattagttaagcaatatcaagagttaattcgccttgatggaagtcagttgacctttactgatggtgcattacgagcaatggcacaactagcaatcaagcggaatacaggtgctcgtggtctccgttcgattattgaagatgtaatgcgggatgtaatgtttgacttgccaagtcgtaaagatgtagaaaaggtaattattgataaacgatgtgtaacgcaacatacagaacctcgttacgttttaaaggatgaaaaagcttcttaatgaaatgaggtaagcaaatggaagttcacaatgtagatttaacaatcagtgccgtaagtgatgaacaatatcctaaaacaaatattccagaaattgctttagttggtcgttcaaatgttgggaagtcatcgttgacaaatgtcttaatcaaccggcgcaattttgctcatacgtctagtcagccaggtaaaacccagacgttaaatttctatgacgttgaggataaggtatattttgtcgatgttccaggatatgggtatgccaaagtctcgaaaaaagagcgagaacgatttggaaaaatgatcgaacaatacttaacccaacgtgaacaattacgcggagttattcaattagttgatgcacggcatgaaccaacccctgatgatgtaaatatgtataattggttacaatattataatattccaacattaatcgtagggacaaagattgataaggtaaaacgaagtgcatggaatcgccaactaagccttatcaaaaagacccttgatgttgagagttcaacaccgattattctattttcagctacagagaaaaagggtaaagatgatgtttggcagtggattgaagagcgaatggggaagaactaagttggattttaatgaataccaaaatgcagcaaaacgaaccttatatgggaatgaacaagttttaacaaattgtgcattaggattagctggtgagtcaggacaagtcgttgatttagtaaaaaactatacttttcgtagtcgaaaattagatcgtaaggaactaatccacgaaatgggtgatgtcttatggtatttatctcagattgcagaatgggccgatattccatttgaagaggttgccaaagcaaatattgaggaattaaatcagcgctatccgactggttttaaaaaacaagattaaaaaaataagcgggggtatgagtgatcacatctccgcttttgcattatttcttttctttatctttactatctttttcttttttatcgtcattttttttagttgcttttggttttttaggatcaatcgcaaattgatcaaataatttatcaagctgttcgcttcttctagtaactaatcccatttttttagctccttttttatatttgacaaaatgctagcataaattttgctaaatgtacaattatttctaaacactttctttgccttaatgatgatttttcagatataatatattgttagataatttttcggagggattttgcgatggccagtgaacatttagaacataaactagcattgttacctgacaagccaggttgctacctgatgaaaaacattaatgatcagataatttatgttggtaaagctaaaaatttgaagaatcgggttcgctcttactttaagagtagtcacaccggtaaagtagctaaaatggtttcggaagttgcagactttgaaaccattgtaacttcgactaataaagagtcgttcttactcgaaataacgctgattcaaaaacatcaaccttatttcaatatcaaattaaaaaagggaactggttatccctacataaaaataacaaatgagcgagatcctcaaattaagatcgttagtaaaataaaaaaagatggtggatattattttggcccttatccaaatgtctatgctgcggaggaaacgatgcattttattcaaaaggtttacccattaagacgatgtaatgggtaccaaggccgtccgtgtttgtattaccatatgggacaatgtttaggagcttgttttaaagaagttcctaagagtgactacgaagagcaaattaagaaaattaagtcatttttgagtggaaacacagcgacagttaagcgacagttaaccaaaaagatgcaacgagcagcagaaaatatggagtttgaacgagcggctgaaattcgagaccagcttcactatattgaagtaacggttgaaaaacaaaagattatttcaaatgataagacccctcgtgatttgtttaatttctatatggataaagggtggctttctattcaaattttctttatccgacaagcacggttaatgaaacgagaaaaacgtctatttccaatcgtggatacggcagtcgaagaaatgaccagctttattcttcaattttataatcgtcgtaataatattttgccgcatgaaattctccttcccaagggtctccctaataaagaaataagtgaaatactaggggtgccggttcggacacctgttcggggagaaaaacgagatctcttagcaatggcacatgaaaatgctcagttgtccttagatgaaaaatttcgactgcttgagatggaccaaagtaagactaccggtgcgatgaaagagattacggatgcccttggacttccagaaggtcaccggattgaagcatttgatcattctcatattcagggggctgaccccgtcagtgcaatggttgtatttattaatggagaaccggctaaaaatttttaccggaagtataaattgaaaacggtgattaatcatgctgacgaagctgccagtacccgtgaagttattcggcggaggtattcgcgtctcttaaaagagaataagccaatgccggatatgatttttatggatggtggcgaaattcagatggatgcggctaaagatgttttagagaatgaacttggtctcgagattccggtagtagggatggtaaagaatgataaacaccaaaccgctgacttattgttcggggatgatgatcaccatattaatttgaatccacggagccaaggcttttacttagttcaacgcattcaagatgaggttcaccggtttgcgattactttccaccggcgcgttcatactaagcattcgttgagctcgcgtttggatgaaattaagggagtgggaccccgaactcgaacaaaattgcttaaaaaatatggatcaattaccaaaattgctcaagcctcagttgatgaaatccattcactaggaattaatcgacctaccgcccagttaatcaaggtttcattgcagaaaaatgctgaggtggcgaagggtagtagtcatgattgagttttgacaggcttataaattttaaatatactaaataatagactaaagaacggagacaatcattatgaatatgtttgttgatcaaataaaaattgaagtacatgcaggtaagggtggcgatggaatggtagcatttcgtcgtgaaaaatatgttcctaacgggggcccagctggtggcgatggtggccgtggcggtagtatcattttaaaagttgatgaaggattacggacattaatggatttccgttatcaccgaatttttaaagctaaaaacggtggcaatgggatgagtaaacagatgactgggccaagtgcagaagatacaattattgctgttccccaaggtaccactgttagggatcttgatactggcaagattattggtgatctcgttgaaaaagaccaagaattagtagttgccaaaggtggccgtggtggtcgcggcaacattcactttgctagtgctaaaaaccctgctcctgaaattgctgaaaatggtgaaccaggagaagaccattacttagaattagaattaaagatgcttgctgatgtcggattaattgggttcccttctgttggaaagtcaactttattatcagtagtaaccggtgctaagcctaaaattgctgcatatgaatttacgacattaactcctaatctcggaatggtaatgctaccagatggccgtgattttgcgatggctgacatgcctggtttaattgaaggagcatcgaagggtatcggccttggattgaagttcttgcggcacattgaacgtacccgcgttcttcttcacctagtggatatgagtagtgaagatcctcatcaagcaattgaacgttaccggcaaattaataaggaacttgctgattacgatcctgaattattaaagcgaccacaaattgtagttgcgacgaagatggatttgccaaattctgccgataacttagccgcttttaaagctgatttggcagcagataagactttagaaaaacagccagagattttccctatttcagcggttactcatcaaggtgttcaacaattaatgcaattaactgctgatctcttagataagacgcccgcatttgatagtgagagtcatgataaagaattggtcgctgaatatcgtgctgctgctcctgacaagaaagatgaagcggactttaccattaccaaggatgaagacggcacctgggtattgggtggtgaaaaacttattcggttatttaagatgactgatttaactcatgaagaaagtcaattacgctttgctcgtcaacttcgccatatgggggttgatgacgcgttaagagctaaaggtgtacaagatggcgatcttgtaagaattgaaaaatttgtttttgaatttattcaataaaattatacgtagcaaaggtaggaaaaatataaatgcaacttgaatttttaggaacaggcgctggttccccaagtaagcaacgtaatgtagcaagtgttgcattgcggttgttagaagaacgaaacgcaatttggttatttgatgttggagaagctactcaacatcaaattctcaatacgacaattaggccacgaaagatagaaaaaatctttattactcacttgcatggtgatcatatctttggtttacctggtttactaagttcccgctcttttcaaggaggaaccgaaccattgacgatctatggaccagtaggaataaagcggtatgttcagacttctttgcaagtaagtgagtcacgcctcagttatcctttgcattttgttgaaataacagatgacggggaactatttaatgatcatggttttagagtgattgcacgaaagttggatcacaaaattgcttgttttggataccggattgaagaagcggatcatccaggagaattacaagttgaaaaattacgagaacaaaaagtaccatctgggccaatttacggccaactaaaagctggaaaaacggttactcttcctgatggtcgcgtattagatggtcatgactttattggcactcctcaacctggacgcattattgcaattttaggcgatactagacaaacaaagaatgcaattttgttagcacaaaatgcggatgtattagtgcatgaaagtacttttgctaaagatgagacgaagatggcacacaattattatcattcaaccagcaaacaagcagctgaaattgcaaaaaaagctggtgttaaaaaattattgttaaatcatatttcagcacgatacaccggtaaagcagcctatcaattggcatatcaagttcgtaatattattcctgatactcgagttgttaatgattttgacgtgattgatattccgtttaaaaaatgaaaagagatggcaaaaaaatgctgagaagagtaaagacgttacgttttctgcgaaatgaagttgtattaattactggtggttcaagtggaatcggcaaagagttggcttttgaggcagctcgtcgcggcgcaattgttgttgttgtttctcgtaaccttgagaagttgcaagaggtagccaagaaatgtttaattttatctggtcggccagcatttgcttatcaattggatgtcaccgaccctgatcagattgatgatgtgctttcgaaggttcaacatgaagtaggaggaatcgatgtattaattaattctgctgggcttggtgactttattcccgtagttaaggaatcttaccgctcaatggaaaaaatggtacatacaaacctcttagccttaatgtatattagtcggtgtgtggctaaacaaatgatggatcaagggtatggggccattattaatatgggttcatttgctggtaaattgcctacaccaaatagcgctgtatattcagcaacgaaggctggggtaatccagtttgataacgttttacgaatggaagttgctgattatggtgtccaagtgttgacagttaatcctggtccaattgatacgcctttctttgataaagcggataatgattatacatatcgggcacatttgccaaaatgggtgtttatctctcctgaagacttagctcgacgaatttggaataatgtcgggtataagacaagggaaattaatgttccaggatatgtggcttatcttggctgggcttaccaagttattcccggtttaggtgactgggcaattaagaaattttttgatttccaacaggataagaagaacttataatatgctcccttattttcattttcgttaaattgcagaatttagcagtttctttcaaaaaatgaaaggagcaaaataaaagagactgagtttatcccagcctcttgtttaattttggcgttgaaatggtggttaattttaaatgattgatgcaaaatttaagtggaaacttgccgataatgcttcctcagcaactgttgataatctcgaaaaagagttaggcatttctagaatattagcaaccttattagctcagcaaggaatcgattcaaccgaacaagcaaaaaaattctttgaaccatcgatggaagagattcatgatccaaccttattgcatgatatggataaggcagttgagcggattgagcaggcagttgaaaagcaagaacaaattactatttatggtgattatgatgccgatggaattactagcacatccttaatgtatgaaacattattatctatcggtgctaatgttaattattatgtcccaaatcggtttacagatggatatgggcccaatatggacgcttaccaacgcctttgggcttatctagcaacgtttttaccattgctgggtattgttgttgcaattagtaacttattttaaggagtaataagaaatgagtttatacactaaaaaatttgaagaagaaatattaagtaaaagaattattgatatagaagacaggattgttaaagctggcagttatataaattcaattactgaagattgttttgaaggtactatcactaaagaaaatggagaaataattgcagatgatccgatttcctcagcagatgaaattattaaggtcgctaaagaaattaaagatttagcaattcaatataaaactttaactgattttgaaaacgactttatggatggtaataaaaaagccgttgatagtgagaacgccaattcagacactaacaacgactaaataaaacttagagaattaaatttagctaataaaaaagccaacaatctttacgggggatgttggacgaattactaatatttaattctctttcattctaacatgagtggagggtttaaacaatggaaaaagataagaaccaagaactagcgtttgaaaatcagttgtgggaagcagattccaatgttgaagaaacaaccggaatagcccaagcactgtatgatcagttaaatgatgtttttgctccaattgtacgagtagacaattatgcagcaatgagtgatgaacaagtgtctacggttgctcaaacagtagtatcacgtaagaaagcattgttagcactatctagtattttgttggataagttagatcaaattcatgatcaattgcaataggtgggacgtgattaatagtgttaagttttgaagaaaaactatccgttaatcctttattagatagtgacaagatggaaaaaattattaattcaacgtcacatccccttaatgagtacgcaaagaaacagtttcagaaagcacttgaatactataacgatgattacaaggttatagaacgagctgttagtagtaaaagtagtagaaaatttattgctctttataaaaataatgaggaaataatttcctactacctaaataaatatcatagcgttaaacctgctattggtgcaatgtgtttttatcttctctactacacaggggatgacgttaaacaagttaaccgaatactgcaccgtacaccactctttaagtattggaataatgctagtcaaaacgaagatcaatcaatagtcgattgggacaatatatacgaagaaacaagtttagacgggaaaagctttgaatatatcaaaacaaaaggcgaagtagagattatcagtcttaaatacaaacgctaaattaccatgtaaagagagggaaaatatggctaatattgatgacttagtaaataacaatagttttccagaatggttaactgtaagtgataaaggaaataaactggttgatgaaattaagttggctaaatatttagaaaaaaagtatcactttacatccaaccaatttatagaacacggctattggttcgatcctaaaagtagacaatggaaaaattacgctgattcagtcattgaaaaatcaatcaaaaatgaaattgtacctcatggaatatggagaacgaacttattagcatcggtttctaaattaattgccttagattcacaagaaattgtagaagacaatccatttgatcaaccagcaccttataaagcagtgtttggtaaacacacttacaacttgatgacggacactttagaagataattcaccagagaactatcttttacaaaatagaccatatgaattagaaacaaaaggaaaagctacaacgtggaataaatggttaaaacaatcattagtaccctcaactaaagaaatccgtgatgatactggaaaactacaagatgaatatgacctaacagcaattgaaacagtaaaagcctttattggttttgctttagcaggtagttttaaggactttcaaatttatatgattctatacgggttgggtggggatggtaaatctacatttctaaataaactaatggagttaatagggaagcctaacgtttcaaacgtttctttagaagcattatccgaccaaaaagaagctaaatttgctacttctcagctgtatcataaagctgctaatgtttttgctgatataagccccaaatttatggaacagactaatattattaaaacattaactggtggcgacgctacaacagctcaatttaaatataaagatccatttaaacttgaaaatgaagctaaattgatttttagcgctaatgatttaccagccttcaatgattttacagacggatttaaaagacgaccaattattgtaacgttccataagattaaacattttaaagagcaattcaaagagcaagactttaaaagagaaatgccagcatttgcctatgaatgcttaaaatcttataaaaaagcacttgattctggtaagtttccagtgactgaatacatggaacagcaaaagcgaagctgggtaaatgctaatgacaatatcggcaactggattaacgattgttgtactacaaatgagaacgataaagaaaaatcggtatatctatatggcaattataaagagtattgtaaaaatactgctgttccttgtcttagtaatcgtaagtttgcgaaagagctaatagcacgaggatacaaacacactacagttaagattaacggtaaaaatgttaaaggttataaaggaattgctcttaaaaattagttatagttttatatttatcggttacctttgcagaagttcttataaagcttgatataaagctatttaaaggtaaccgaaagcattttgaggtaaccgatagtttcgggttactatattaagtaactgcaatgtatcggttacctttatatcctatcggttaccatataaatgttgatataaaggcgattgtgggtacttgaaacggggtaaccgataaaagtaaaaactattttcaattgaagagatgaaaattaacaattaaaactgcttttaccgtacttttattttgaggcagtgaccacataccaccggataggtgaaaagcctattaaggagttaaaaataaagtaacagtagatttcactagaacggctgcaaacgttctactattgcttgtatctgcaagtacaggcagaaaggaataattaaatgcgaagtaataaatacgcaattacacgattaaagcataaggtcacattcggtcatgaaggtggtacggggaaacgtaacccgaatactggtaagatcatgacaggttttgtaggagatgtgacagtacattgtggtaactattcaatcagtgctagtcaagctattagtgaggcaggtagttcaattaccgatgatgttatattggtagttcgtcacaagaaagatttaacggatatgaagaaatatccagaagcacaatacaatggcaatatctataaagttgctggttggtcaattgatgatgagttattggcgtataatactgtaaccttacgcaagcttgatagtcataaataagaggtgaaatggggatgagtaaattaacagtcaacacgcacccagagtataacaactttattaatgtaatgattgaggcaagcggtgatgatccttctaattatcatatgtatactacgctttatagtttaaaattagtctcagtaaatggcagtccattaccattagctatagatttaggattgccagagaacacagagctagcaaagtatatagcacgtgtggcagtttgtaaggacgcagaggaaagccgcaaagattggttaactatcgcgaggtataaagcaagtgaatgtgatccttatagtgctaatctatcagagttagaagcttgtatgacgagaacggttaacgatattaaagactggaatatcagcaagctaaaagctttgagtaaagtaatcgagattattaatctgtaaattatggaggtatcgtattatgcggtaccttttttcataggaggttatcaaatgagtgtagtaagattctgtagtgctgctggttgtcgggaagtgattccagtaggtcaatatttttgtaaaaaacatcaatatctacaaaaagaatatgaagacaagcgtaaacattggcaacgagataactataaaaagatgaccaaagaacagaaacatgaatacaacagaaaagtatacaaaaagcgaatggaaagaagcgccaaagctcctcatgactataatagattctacaaaacgagtaagtgggttaaattaagccgtcaaacgctccagaaaagcccagtttgtgttatgtgtttacgaaagggaatagtaaaaaaagctgatttagttgaccacattgtacctatacgtgaagattggagtaaaagattggattcaactaatctacaatcactttgctatcgttgtcaccgagaaaagacaagaaaagatcatcaacgagaaaggaaaataaatatgaatagctgaaataattttaatacccccgctattggtatagaccggtaggagccgtaatggtgggggtttcttttaaaaaaattctccctttacaaaaaaacgccttaaaatccgaagatttcaagacgtttctttttattttgtatggttttcttttcaactttattaaaaaatttagagcctcaaatgtcaaggattttttattataacttttaggcattgaacttaacaaactattcaaatatggtataataagggttaaataatacgataattgaatatgaaatgatgtttttttattttttaaacaaatggtgacatggtgtcactaaataaatagaaggaggtaaaatatttggttcaaccaatgaagacccgtccagaaggtcatattactaaggcagaaaaagcacaacgtgaagacgctgaaaaagcattggcagaatacccaaacttaacatctcacgcccctaaatggcttgatgatgtagcaaaaaaggaatggcgtagaattgtcccactcttaaagaagagtgcccctattagcgaactagatgttagtttaatcgctactcactgtactttgtattcaacaattatcaaatgtactaaagagattgatcgtactggggtagttattgatacaaaacgaggattacagcagtcaccttactacatggcacgtgataaggctattaaagaaatgaagtcaattgatagtcaaatggcacttagcccacaatcacgggtacgcctagaagtccacaaggcaatgagtgaagaagctcctactgatgagtttgaagagatgttgtcataatggatagagctattcaatacgctaattcagttgttaaaggtgagttagtcgccggtaagttagttactcatgcttgccagcgcttcttagacgacatgaaaaagcaaaagaccgatgactttccttattattattctgaaacgtatgctggtaaggttattaaatttgttgagagcttaccacaaacaaacggtgaaccattaaagctagagccatttgaagtgtttatcttatctaatatctatggttggcgacaggtagacgataattcattgcgcttcaatcggattctattaagtgaagcccgtaaaaatggaaagagcttcttactggcagcgattggcgttgtgtctcttctaatggaaaagcaaccagcccgtaaccgacaaatactatttactgctaacagttcccagcaggcacaccttgcgtttgatattatgagtgaccaactagaaaacttacggcgtaattcaaaatatttaaggcaacgagtgaaaatcaataaacaacgggtgactgacaaaaagacaggtagcttcgcaattccactatctactgatacccacagtacggacggttataacccgacactgggcgtagtcgatgaatatcaccaagctaaagataacactattctaaacgccttgaattcgggtatggctcaacaagacaatggtattctagcgattatttctactgctggttttaatcttaattcacccttcaaaaatgaatgggactatgcagccgatatacttaacagcaaaattaaaaatgatcgttactttgcggttatgtattgccttgataaaaaagaagaaatatttaaccccgagatgtggattaaagctaatcctttgatgagtaatcctaagattgctaagacaatgagggaacacattcaaaatgatttagatgtagccacaaaacaaaataatattaataacgtacttgtaaagaatatgaatatgtttgtacagcagaatgaaaattcatatattagtacgcaagattgggaacatggattgattgaaaaagctccagatattagtaatagagatgtttatattggtgctgatctatcaaaaagccgagatttaacggcgattagttggttagttccgttagaagatgaaaagttttacgctgattcccacgcctttgtatctcgttatggtggaattgttactaaatcaaaacgtgatgggattgattatgaaatggctgctaaacgtggggaatgttcaatcagttcattagaaagtggcttgattgattatgattccgtatatgatttcgtgatggacctaatcggtaagtataatctcaatgttaaattcttagtatttgacccttataaatgggctgatcttgttaatcgttttgaacgggcaggactaccacaacttcagttaacacaatcctataagaatttatcggtaccaattgggacttttaaggaagaattaattgctggtaacattcttcacactaacaatcagatgttagcttacaacgtagaaaatgcaatattgaaatataactttaatggtcaagctttacttgataagactagaaaacaaaataaaattgattgtcttgcggctcttatggatgcttgggcggctggttatgattacttcgctaagagaaaggagcaagaacgtacaaatgaatactatgaaactgctaaaaatcttttctagctatattaaaccggttttgttgatcaccggaggcgttctaatggagatcagtgctataggattaaccggttggttgtttgggattggctttcttggtattgaaatgattgttctagctttcatgattaactattctgataatcacaagtaaaggagggtagataatgggcctatttagtaagagaacaacgactacaagcgcacaagatccatttctagaggctctagtaagtctttccagtaatgatcctaatgcttatgttagtgcttcggctttacgtaatagtgatatatttgctgcaattagttctatcgctggtgatcttgccagtaatccgattaagtctagttctagcctatataacaagatgattaatgatcatcctaacgagttaatggacggcagaagtttcaagtacgccctagcggttgaaatgctattaaatggtaatgcgtttgccgaaattgatttaagttcacacacgctaaattttattcctaacaataaattaactgtccagcaagatgatgtaacgcaaaagctgacttacacatacagcccagatggacgtattaagcgagtaattgcctcttctaacatcttacattttaagtattttacccgtgatggtttagtcggactatcgccactgtatgcgctaaaagatgaaatgaagatacaggcggctggaaacaggttaatgactggattctttaataatggaattcatggcacaacagttgtccaagtccaccaagctgatcttagttcggatggtaaagagaatattagaaaacaatttgatgaggcaactaccggtaataattcacttaacacaattgttactgatgatggtatggacgttaaaagcctaccacttaatacagacgtgttaaagctagtaaattctaatgactggaatacccgtcaaattgcgaaagcgttcggactaccacccgagcgtttaggtgtagaaaacgagcatagcaaccaacaacaaagtaacgttcagtatttacaaggtactttacagcactatgaagattgctttacttctgaattgaactacaagctagggcaagattttagctttgataatagcaagctattaagccttgacccgtccgctcaacagcagatggcagttgatggttatgttaacggtatctacacacgcaatgaagcccgagccttacttaatttagtgccagtaactaatggagataattttattgaaaaagaaggaggagttacagccaatggagaaacgactaacaactaacgcaggtttacaaacggtaagccctaaagaagacccaacaaaagaccagcaagacaaccaagatgaaacgcaagcctcacagcctaatacagttgaaggctatgcgttactctttaatcaacccagcaaggacttaggcggttttgttgaagtgattgaccctagcgcccttgataacgtagacctatccaatgtagttatgcttgatcaacacgactacactaagccactagcaagcgttaaggctggttcattacaacttgatgtggacgataaggggcttcacttcaaggcaactattgatccaagtgtaagttacgcaagtgacactcttaataatgttaagaatgggaacattaattctatgtctttccgttttgatgttgatgatggttctgacagttggacacgtgacgacaacggacaaattacacgcaccgttaatcagattaaagatttatttgaggtttcaaccgttacagtgccttcatatgatcagacaaatgttgatgtagataaaacaagcattcgtagttacaaccaatttatcgaaagtgaggaacataataaaatgcaacacacaatcttagaccccaaaaacaatacagaacaaccagctaacgcctttgaaagcttcattcgttcacgtggtgaaacccgtgacggattaacaactaagggggcagaagctgttatcccagaagaagttgttactccagtcctagacttaaagaacagtgcttataacttagcgaagtacgctactgtaaagactgtagggactggttccggtcattatccaatcgctacccgttacaacacagcggtacttactactaaggaagaacaagcagaaattgctgatgtagacgctaatatgtttgaagatgtgaagtttgatgtaaagacccgtgccggtaagattgcactatcaaatgaagttgttgacgattcagaagttgatattgtatctgaagtaaagaaccaacttcaaaagttagttgataacactgataacgctgaaattatcaaggtattacaaggcgataactttactaagaaaaccgtagctaatgttgatgacttgaagcaagtattcaacgttgaccttgacccagccttacaaagtacttctacatggttagtaaatcaatcagctttccaagtattagatactttgaaagacaatgaaggacgttacttattacaaccagatgtaaccgctcctagtggattttctttacttggtcaacccgttgttaagattagtaataagttcttaccagataacacggacggttcacatccaatgattttaggtgatatttcagaagcggtagcagtattccggcgtaatcaagttacagcccaatgggacaagttcgatagttacagtcaaggcttatctgttatcgtccgtaacgactaccaaccaattagtaatgacgctgctttcaatctctctttaaccacaactaaggcaaccgaaagtaaataatagctactagcacagggtgggcaatatcgcccactctttttttatgaggtgtattaatgcgaaaagaagtaaaaagtctagtaatagtaatactgaaagattatccttcaattgataagaaactaaagagccgtaagtttgaactaatgcacccactccacaaaagagatgaaaatgtaggcggtggacgtgctattaatcgcccgtggacttattacgatgatatgttaataaccattgaccaagatagatatatgcaccgcttaaaacgtgagaaagaagctattgacttagcattacaagacgctggggactgtacccagaagataattaaagaatgctattttaaccctaatcataagacgataaagaacctagtagcaactggcgatatatggtgtagcactacaaaagcgtacaagttacgtgatcaatttatagtagatgttgctaaaaagttagacctagatgtgttctaaaagaaggtgaaattaatgaaatttgatgtagagcagtgggaagtagacaactttaagcaagccttatatcttgacggtgaagaagaagaccaattaatcaaggattatctaaagaacgctaaggcttatgtacaaaacgctgtaaaccccacagcagacttaacccagtatgaacaatatacgtttgctgttcagatgttggcgcaattttggtatcaaaatagaggtattgacatgtcaaataccccttaccaagtgttaagcatgattcaacaattgcgggggcttgtatagataactagtatagattggtgcgttatatacctaaaatgtatggtataattaataacgggaagtgagtaaaacttcccgtgaacattaagtgtttggagcaatacagccagcattacagtatttattttctttcaagccttgtaaactccttccagaatatagctatcaaagtcaccatagtagaaagttttattcaattggaaaggggatggttatatggaaataaagtataaccgttttcttgtcgcttagttaagcgataggaagtataaagtcgtgacggacaagaatacaatggtttctttgatgtgtggactgactaatgttattgcttgattagtgcttaatgtctattaggcatattttgttgagtgtgggttaaagtctttaatggctttcttatttttaatttggtagaataaatatccatattttccttagtcgggctttaattagtccggctttttttgctatcaaacgaaatgaaaaagtataaaacgggtgattgatcatcttgttttgttagagaaggaattaaaccaagggtagtgtttccagaaatcgagaaaactttttttgtgatgataaataaaaaacgccacgtaaattgtgacgattggaatatgtatttaaataagtagatatgtatcttgccagccagaagatattgagaacattttgagaacaaaaagtgatatatgttgaaatgttgcgataaattaaagggctgttaaaccgctatataaagcaatttgaacaaccctttaacattctggttaattatctaaggagacaaggggatttgaacccctgcacgcttttacacgcctaacggttttcgaaaccgtcctcttcagccacttgagtatgtctccatttcaactttatcattgtaacaaaaaaattgtaaagcgtaaagagaatatcaatcaaggaaatagctatttaataattttgcagaaatgatttcttgctgatatgatattctaatatatgatgtaatttgaaatttgattaggggatttttatggtaaaaaaatattatgcagtcaaaaaaggtcgtcatccgggaatatataaaacttgggctgaatgtcagaaggaagttaatggatatccaaatgctaagttcaaaagttttttaacacttaaaggtgctaatgaatggcttcaggctacgggaaataccgtgccctcgactaaagcagttgatcattctgataatattcttgtttatactgatggaggctcccgtaatcatggcaataagttggggcagcatgttaaggcagatgataaagcagcttgggcttattttattcaaactaaagatcaagcttatacaggaacggctggcgaattcggggctactaataataaaatggagattacagctttaatccaagcgttaactaaactattagaacttggcctccaagatcaaccaattacagcgattttggattcacattacgtactagacccaattatgaaaggctggttaactaattggcaacggcggggatggttaactgctagtggcaagccggtagcaaatcagaagctatgggaagaaatagttacccttttacctcaattccctaatttacattttgattggactaagggtcatgcaacgaatgctggaaataataaggtcgatgaattactaaataaaacgatggatcagttataattatttgacaagaggatgataagaaatgagaattggtattgacaaaatggcttttgcaacaacaaatgattatttagatcttgttgaattagcaaaagaacgcggcgtagatcctaataaatttaccattggaattggacaggatctacaggcagttgtgccacctacgcaagatattgtgactttaggagctacggcagcgaaaaaattgcttactccagaattagaaaaaaatatttcgacagtaattgtggcaactgagtcagggattgacaattcaaaagcaagtgcaatctacattaaacacttattaggacttagcgactttatccgaacggtagaaatgaaagaggcatgttattctgcgacagctgctatccaatttgcaaagggggtagtggcgcttaatcctcaagaaactgtattggtgatcgctgctgatattgctcgttatggattaaatactccaggagaggtgactcaaggagctggagcagttgcaatgctgatttcacagaaccctcacatcctaacccttgaagatacaactgtcgcttatagcaaagatataatggacttttggcggccgttatatgcaacagaagctttagtagatggaaaatactctactaatgtttatattgaatttttccttcaaacttttacccgttaccagcaattaactggtcgagaattagcagattttgctgcccttacattccatatgccatttactaaaatgggaaagaaagggttagaagggttgcttaaagatcgtaatgatgaggtagctcaacgattacgaacacaattaaccgcaagtcagctattttcgcgtcaagttggcaatctttacactggctccctatatttatcattaatgtcattgttacaaaatagtgacttaagagctggaagccgaattgggttatttagctatggttctggtgcagaaggagagttctacacaggaatcctagaagatggctacgagcattatatgaataatattcaagaagaactaaaacatcgtcatcaggtttcggtggcagaatacgaaaaactatttagtagtcaattaggaatgaatgatcgggatatcgaatttgatgttgctgatgatccattgcctttcgttcttaaaggacaaaaagatcaccaacggatttatgaagctaaataacctaataaaaaaggagccccaaaatggactccttttttatttagaaaatatgatcacgaaatagtcccactactttaccaaggattttaacattgtctaagaagattggctccatcgtatcattttctggctgtaaacgaaaacgtgttttttctttatagaatcgtttacaagtagcttcattatcatcgttcattgcaataacgatatcaccatttttagcagtggattgtttacgcacgattacttggtcgccattaaaaatccctgctttaatcatactagttccgcgaatggtaagcataaacaaatcattattatcttgaatagaaggaggtatcgggaaaaactcagtagcattttcgactgctaaaattggttgtccagccgtaacaacaccaagcattggaatttctttttgaatcggttttacacctaaaatatcaagtcccttgggtgtaatctcaagtgctcgaggcttagaagggtctttttgtaagaatccttgttcaattaagcgggaaatgtgtccatgaactgttgaagttgaagacaggccaacagcactacaaatttcacgaacagttggtggatagccatgatcttcaacttgtttgtgaatataatttaggacggccatttgtttattttttgctagctttgccatattgacacctcattatcattaattgtgttaagcttatcatagatagatgcatatttcaaacgtacgttcgcgatttgcattgattttataaaataagtaaaatcgactttattaaggagatgattataatggctgaatctaaagaacaagatgctttattgaagcgaattaatgaacttgctcataagaataaagaagaaggtttaactgaagaagaaacaaaagaacgagatcgtttacgtaaggagtacctaaagaactttagagaagcaatgcgtagtaatattgaaatgatgcggatctttgataaagaagggaaagaagttactcctgaaaaggttcgtgaaatccaacgtaaaaaaggacttcgtgacgattaacagcgatttgctcttttcaaaaattgctctttcgtgtaagatggataggtaacgagcaaaggaggaagtaattgtgggtatgacgatcatgctaatgattcttgcattattagtcggtttggttatcggcttctttggtgcacgtaaatacatggaaaactacctccgcaataatccaccgatttcggaagagatgctgcggacgatgatgcttcaaatgggacaaaaaccatcaagtcgtaaattacatcaaatgatgcaagcgatgaaagcacaagctaaaaagtcgaatcgtaaataatataaaaggatgtgataattatcacatccttttatattggaaattaaaattcgtcattcttcggctttggaggaacaatatatttataattgggatcaatttgtctatctaattggtcaaaggcgtcttgcatttgcttttctaagtcagcctgtacttcgggagtgagccgttgctttcggtcaatataaataggcttcccaaatgcaatttggcgcggcttacgggtaaatagctgaccaaattttaggggtccctggtaaacagcaggaactaaggggacgtttgccattttagcgatcacggtggccccgccttttaatttggatgagtagcgtgatccactaggaaaaataatggtcgataagtcagttttctttaaaattgtaaccggctttttaatagcagacgggcctggatttttccgatcaactggataggcatttagtgctttcaagaatttgctagcaattggattcttaaaaagttcttttttagccatgaagctaaattttttaggccatacggcaagcgctagtaagacaggatccatccaagtacgatgaggtgcaataataatataattgccttcagggatgttttcccgattgtatattttaggtcgtccgttaatcaaatttaaaaatggattaacgattttaacgaggaaagtgtacaacatgtcaatcttccaatctataacaaaattaagttttcgttcctcagtatgacgaaaaaaagtggatcttgcaagtacaaaaataatggaggacataatggaaaacagaaatattctaaaaaaggatgaaagaattgatcaattatatagtcaggatgtacggataatccaaaatccccattattttgctttttcgttagatgctgtcttattagcaaactttgtgcgtcctaatcatcgacagaaattaaaaattgttgatttatgtgctggaaatggggcaatcggcatttttctccacgataagcttggcggaacatttactgaagttgaattacaaccacagattgcggatatggctgaacggacaattatgctaaatgatttacaagatcggtataccgtcattaatgatgatattgctaacgttaatgattatatttctaaggattcgattgatattgtcctttgtaatcctccttatttcccagttacagcccaaagccagaagaatccaaataaagctttagcgattgcccgtcacgaaatagcgactgatttagtgacagttattcaaaaaatgagtggcttattaaaaatgaatggtcatgggtatcttgtgcatcgtccagatcgtttaggtgagattttgcaagtgtgtcaggaaaatagattagcacctaaaagaattcagtttattcatcctaaacctgatcgtgatgcgaatattttgttgcttgaagtgattaaggatggtcgacctggaggagtaaaagtagtaccaccattgattgttcatggagcagataacgagtatactccagcgattcaggagttattatatggcaagtgaaaaatactatatttatgtattgtattgtgcagataatagcttttattgtggctttaccaacaatgttaaacgacgctttcatactcatcagacttatcaaggggcaaaatatactcgtgtgaaaaagcgtcatccgctaaagcttatttattcagaggaatttgaatcaaagcatgatgccctgagtgcggaatattattttaaacatcaaacccgccgccaaaaagaaaaatttttactagaccatggtgtcgatttattgaaactacggaggaattaagatgaagatttatatgtatggtgtttatcaggatgaagttccttacattaaggaatggcaagaggaacatcctgaagtaactgtagactcaacaacgaaacttttagacgaaagcacagttaacttgtctaaaggaagcgatggagtagtagtattccagcaaaagccttattcagacgaggccttacgtcaattagcacttaatggtattacaaagatgtcattgcgaaatgttggggttgataatcttaaccatgaattagtacaagaacttggttttcaaattaccaatgtaccggtttattccccagctgcgattgctgaattttcagttactcaagcacttaaccttttacgtcgaacaaaagaattttatttgaagttagcaaaaggagattataactgggcaccgcatattgctaaggaaatgaataagcaggttgttgggatagttggaacaggaaacattggatctacggcggctaaaatctttgctggttttggtgcaaaagtgattgcatatagccgtcaccaaaataaggaactagagggaattgttgaatacgttagccttgatgaattatataaacgggcaacaattatttcactttatttacctcatgttccagcgacagataaaatgcttaatgaaaaaacatttgcaatgatgcaggacggggtcttactggttaacactgcacgtggaccattagtcgatgaaaaggcattgattgaagcattgaatagcggtaaagtcggaggagctgctctagacgtaatgactggtgaaaccaagatttttaaccggcaaattaatttccaagaagttgattatgacgaatttaaagatttagttgaccggccaaatgttttaatcacgccacatattgctttttatactgatcaagcaatcaaaaatatggttaagatgagtttgtctgccaatctagatttgattaaaactggcacctcagataaactagttaaattttaaaataagttaagtgaaaaaccttgtcagtttgcaaggttttttgtatactatatttcggtgttacacgccaatttcacacccagaatgatggtggtgagggtgcttaaatagtcccattgccagaagaagactggggaggaaaaacaatttggaggtatatttatgtctgttgtatctatgaagcaattgcttgaagccggtgtccacttcggtcaccaaactcgtcgttggaacccaaagatggaagagtacatctttactgaacgtaacggtatttacatcattgacttacaaaagactgttaagttaattgatactgcttacaactacatgaaggatgttgctgctaacgatggtgttgctttatttgttggtacaaagaagcaagctcaagatgctattgaagaagaagctactcgtgcaggtcaatactacgttaaccaccgttggttaggtggtactttgaccaactggaagactatccaatcacggatcgctcgtttgaaggaacttaagaagatgagcgaagacggtacatttgatgttcttcctaagaaggaagttgctgtcttaactaagcaacgtgaaaagcttgaacgtttccttggtggtattgaagatatgccacggatcccagatgttatgttcattgttgatcctcacaaggaacaaatcgctgttaaggaagctcaaaagttacacattccaatcgtagctatggttgatactaacactgacccagacgacattgattacgttatcccatcaaacgatgatgctatccgtgccgttcgcttaatcacttcaaagatggctgatgcttttgttgaaggtaagcaaggtcaagacgatgctcaacaagaaactgctgatgataacgctgctaacgaaactgttagcgaagattcattaaagaacttgaagaacagcgttgaaggtaaagaagactaaaaacattaaattcttgggctgttttgtacggaccattctggcctaagtactaaacagcccttttttcaaaaaaagattataaaaggagagatttcgtcatggctgaaattaaagctgctcaagttatgcaattacgtaaaaagtccggtgccggtatcatggatgctaagaaggcattagttgctagtgatggtgacatggacaaagcaatggactaccttcgtgaaaagggtattgctaaggcagccaagaagagtgaccgtgttgcagctgaaggattagctgatattgctgttaatggtaatacagctgcaatcgttgaattgaattcagaaactgatttcgttgctgctagtgaaccatttaaggacttattgaagaaggttactaagttaattagtgaaaacaagcctgctaatgttgaagaagcattagaaatcaagactgaaaatggtacattaaatgatgatattatcagtactacacaaaaaactggtgaaaaggttagccttcgtcggtttactgttgtagaaaaggatgacggcgatagctttggtgcatacttacaccaaggtggtcaaattgctgcattggttgtcttagaaggtgctgatgatgccactgctaaagacgttgcaatgcacgttgcagctatcaaccctgaattcatgactcgtgatgatgtttctcaagaacgtcttgaccatgaacgtgctatcttcaaggaagaaaccttaaacgaaggaaagcctgaaaagatcgttgacaagattgttgaaggtcgtttaaacaagttcctttcacaaatttgtttagcagatcaagactttgttaaggattctgaccaaactgttgaacaatacgtttcaagcaagaatggtaagttgaagtccttcattcgttacgaagtcggtgaaggaatcgaaaaaaagcaagatgactttgctcaagaagttaaggaccaaatgaactaagcgttcggtcaaaaggaggacgtactcaatgtagtgcgtccttttttaaaaattagcttaccaattcaaggaggatatcatatggcagatattaaatacaagcgagtaattttaaagctcagtggagaagcattagctggtgacaagggttttgggattaaccctcccgttttaaaggatgtggctaaggaattaaaagaagttcatgatttgggcgttcaaattgctattgttgttggcggtggtaacatgtggcgtggtgttactggtgctgaattagggatggaacgggcgcaagctgactacattggaatgttagcaaccattatgaatgccttgtcacttcaagatgcgcttgaatcaattggtgttcctacacgggtacaaacttcaattgaaatgcgccaaattgctgaaccatatattcggcggaaagctattcgtcatttagagaaagatcgaatcgttatttttgctggtggaacaggaagcccttacttctcaactgatactactgccgcattacgagcagcagaaatcaacgctgatgccattttaatgggtaaaaatggggttgacggtgtttactcagctgatccaaataaagttaaggatgctactaagtttgatcatttaacccatatggatatcattgaaaagaatttacatgtaatggatactactgctagttcactatcgatggacaatcatatcccattggtagtcttcaacttgaacacatcaggaaatattatgaaagtagtaactggtcaagaagttggtacaacaattgaaggagactgataatatggctacaggaaaagaaattttaaatgatgccaaacagaaaatggcaaaatcaggttatgcacttcaacggacacttgctgatattcgtgcaggtcaagccaatgcaagtttattaaattctgttaaagttgaatattacggagcaccaactccattaaatcaagttgcatcaatcacaattccagaagcacgacaattattaattactccttatgatgagagcgtgcttgaagaaattgaaaaagcaatctatgcatctaatttaggattaactcctcaaaacgacggaagttcaattcgcttaattatcccacaattaaccgaagatcggcggaaagaattagtaaaagacgttaaggctgaattagaaaaggcaaaagttgcagttcgaaacgttcgtcgtgaagcgatggatgacttaaagaagggtaacaagaacggcgactttaatgatgatgaattccatgatcttgaaaagaaagttcaaaacgaaacagatgctggaattaagaaccttgaagatattgcaaatgcaaaagaaaaggaattaatggaaggctagttttcagaattaaaaaggttgtgaactttgcgtaagtccacaacctttttatgtgcgcccggcatgggtattagctaggcggtgagagtccgctatgggccgtagtagtcggaaccatgagctgaggacaagggtgtccactgtgaggtggaatctgaaggaagtctaaggcaaagtactgcaccgatgaacaagaagtagctataaggctggaactaactggataagactgcatgacaagttaaagtccaacactactcgaagttactttcagtaaagctaccggtgacatggtacgaaagttaatatccttacccggggagatctggcctacacgtttccgacaagaggaataagtttaatttccacagaaacaagcggtgcagtgatgtagcgttgagtaagccagaagtcagccgaggtcatagtagtctgagtaatcagatgaaggactgaacgacaataacttgtaacttatatcggagatgtaatcaggtgcgacaatcgcagaaaacagaacaacaagctgaccgcttgtcgaggataggtttggaaaaccgaaagtacacaagggcgcgtagtaccgattatggtgaaggtaaaggtatgagtgtcactatccaagacttagtcttggaccgcaataaccttaatcaggcttatttgcgagttaagagaaataaaggggcagcaggcattgacgatatgacagtcaatgaccttctgccatatctcagagaaaataagagggaattgatcgctagtttgcgtgagggcaagtataaaccagcaccagtcaaacgggtagaaattccgaagcctaatggtggagtaagaaaactcggaataccaacagtggtggaccgaatggttcaacaagctgtggcccaaattcttacacctatctttgagcgtgttttctctgataatagttttggcttccgccctcaccgtggggctcacgacgctattgcaaaagtagtagatctttataatcaaggttatcgaagagttgtcgacttagacctaaaagcctattttgataatgttaatcatgacttgatgattaagtatcttcaacaatatattgatgacccatggacactaaggctcattcgtaagtttctaactagcggagtcttagaccatgggcttttcgctaagagtgaaaaaggaaccccacaaggagggccattgtcaccaatactggcgaatatctatctaaatgagttggataaagagttgactagacgtggtcaccactttgtgcgctatgcggatgattgtaacatttatgttaaaagtcaacgagccggagaacgagtaatgcgaagcattacccagtttcttgaaaagcgattgaaagttaaagtgaacccagataaaaccaaagtcggtagcccgctacggttaaagtttcttggcttttcgttgggtgtagagcacaatggagcctacgcccgtccagcaaaacaatcgcaacaacgagtaaagaaagcattgaggttattaactaaacgtaatcgtggaatatctctgacaagaatgtttgaagaaattcagcgaaaaatgcgtggatggcttcagtactactcaattgggaaactaactgactttattcaacgccttgacaagtggttgagggcccgaataagacagtatatctgaaagcaatggaagaagcttaaaactaaggtaactaacttacagaagctggggctgtcccagcgtgatgcatacgtcttcgctagtacccgcaagggctactggcggaactgcacacagtaagaccttgagctattctctaacaaatagaaaactggaacaactcggacttatgaatatgtccaagacgctccagtcaattcaaagtgattaagttgtcgaaccgccgtatacggaaccgtacgtacggtggtgtgagaggtcgataattgaactaatcaattatctcctactcgattaatgtctttagacctagttgagtgcgcgagcagagcgagtgcacgaaacaaaaaatcacctgctatgcgggtgggcgataaaaattatataaaaaaggcctcttttgccttaagatgtaggtgttcaagccaaagtcaataagggaaaagaggttatataaatatggctaataaattaaatagcttagcccatacgaagtggttatgtaagtatcacatcgtattcataccaaagtatagacgtaaagcgatcttcaatcaataccgaagagacctgagagattatattcgtttgttgtgcaaatataagggagtagaaataattgaaggtcatatgatgccagatcatgtgcacttgttagtaagtattccgccgaaactaagtgtctcgcagtttatgggatacttaaaagggaaaagtgcattaatgatgtttgatcgacatgcaaacttaaaatacaaatatgggaaccgacatttttgggctgaaggctactatgtgagtacagttggattaaatgaatccacgataaagaagtatatccgagatcaagagaaacatgatatagcaatggataagctaacaagtgtggaatattcggacccttttaagggtaagtgaggtagtataaacaccgcttaaagcggtggcaaagtagtcagagcattttggcttgagcaaagcgaaagccagcgccttgagacgccggcttttattatcggcttatagccgatgtgcaaaccacccgtttgacgggtggttatgattttggctaaaattgaattgttatgataaaactatgtaacaatttcctgtggattgacaaatcgaaatttgcctctggtataataaaagctataattaattggcagacgtgaatttttaataaatgtctgtaattaatcctaagtacatgataaaaatggaggaacaattagtgttttccaaaagtaaacatgatgaaataaatcagcaacttgatatggaacgtattcctaaccatatcgcaattattatggacggtaatggtaggtgggcgcagaaacggcaccttccacgagttgctggtcataaacagggaatgcaaacagtaaaaaagattacaattgctgctagtgaattaggggtaaaagtcttatcattatatgctttttcaaccgaaaactggaaacgtccttcttcagaggtaagttatttaatgcagttgcctgtccgcttcttctcaacatttgttccagatcttgtcaaacataatgttaaggtgacagtgatgggagatattacgcagctacctgaagctacgcaaaaagctgttaaagatgcaatggctgatacagcccattgtacggggatgattctcaattttgctttgaattatgggagtcgagatgagatcactcaagctgctaaaaaaattgcagaagacgttcaaaatgggaacttggcacttgcggatattgatgaagcttcgtttggtaagtacttgatgtcaacacaactgggtcaatttgcgaatcctgacctgttaatcagaacaagtggcgaagagcggattagtaactttatgctgtggcaaattgcttatagtgaattggagtttgttccagaacactggccagactttgatgaagattcattgcgatcagcaataattgcctatcaaggacgtcatcggcggttcggtgggctaaaaaatcaataaataataaggggattttgttttgaaaacacgaataacgaccgcggtaattgcacttgcaatctttataccgcttattatatatggtcattggccattaacaattgcagccgttgccttaggaatggttgcaatgtcagaagtattggtaatgaaaaaaatgtttgtaatttcgtttgaagctttgatcagttatctgggggttgctttattaatactgccggatagctggcttgacttcttgcctagtgttgcaactcgatggttcggattctatattttagttgttttacttctattacatacggttattcgaaaacaacgctttactttcgatgatgctggggttttaacattagcaatgctctatattggaatgggatttcgctattttattgctgctcgtgcaatcaatttccaaacgctattatatggaatgttaatcgtttggattacagatagtggagcatatttaattggtcgaaaactcggtaaaaataaacttgctcctaaaattagtcctaataaaacttgggaaggttcaattggtggtacattagcggctgttattattttggctatttattgctactttatccctgttggcgcaggttgggtaacaatgatattcgttactttgattctttcaatcttcggtcaatttggtgacttaattgaatcatcattaaaacgctactatggtgtgaaggattcaggaaaaattcttccaggccatggcggaattttagatcggtttgatagtatgctaattgttatgccaatgcttcatttattagggatcatttaatcaaacgtaaggaagagattttttgataataacaattattacatttattattgtttttggaatccttgtccttgttcatgaatatggtcattattattttgctaaacgagcaggaattctggttcgtgaattttcaataggaatgggtccaaaaatttggtggagacgaaaaaatggtactacctatactattcgaattttgcccctcggtggttatgttcgtttagctggggctgatgatgaggaccaagatgagttaaagccaggtaccccgctaacgattcaactaaatgatcaagataaagttattagtattaatgctagtgataaaacaaccttatttcaggggatcccccttcaactagttgcttgtgatttagaagatggcttatggataaaaggatatgtcaatggggacgaagatcagctaaaggtatatagtgttgaccatgatgcaatgattattgagcgagacggaaccgaggtacagattgctccacgtgatgtgcaatttcgttcagcaagtctgcctgcacggatgatgaccaattttgctggtccgatgaataatttcattttgtccttagtggtatttatcattcttggcttcaccttaacgggcgtaccaactaatagcaatcagttagggcaagtgaatgccggttccgtagctgccaaagcgggcttaaaagcaaacgatcggattgttaaggttaataaccaaaaaataaataattggactgacctttcaacgaatatttcaaataagcctaataagacagtgtcagtaacgtatgagcgtggtaataaaacttatcatactaagctaacaccaaaagcggttgagcgaggtcatcaaaaagttggccaaattggaattgttgaaaagcaagaaaagagtttagctgcgcgtctgaagtttggttggcagcaatttatccaagcaggaacattaatctttagtgttcttggccacatggttactcatgggtttagcttaaatgaccttggtggaccggtagcaatttatgctgggacatcgcaagccacctcattgggaatcaatggagttttaaatttcttagccctcttatcaatcaacttaggaattgttaacttattaccaattccagcattggatggcgggaaattgttattgaatattgttgaagcgatcattcggcgaccaattcctgaaaaagctgagggaattatcacaatgattggtttcctaatcttactaacacttatggttctagtaacatggaacgatattcaaagatattttattcggtaattaaaaaaacaaaggagtatattttttaatgaaacagtcaaaggtattaattccaacaaaaaaagaggccccaagtgatgcggaagccttaagtcataagatgatgattcgtgccggatacatttaccaagtatctgcgggggtatggtcatatttgccattagcttaccgggttattcgcaaagtagaaaatattattcgtgacgaaatggataaggcaggagcggttgaaatgcttatgccgggacttcttccagctgatttatggaaggaatctggtcgttacgaaagctatggtgataatcttttcaaacttaaagatcgtcgtgaccgtgactttattttgggcccaactcatgaagaaacctttactgaagtattgcgtgatagtattaagtcgtacaagaagcttccattagtagtttaccaattacaggataagtttcgtgatgaagatcgtcctaggtacggtattctacgtggaaaagaatttgaaatgcttgacggttactccttctcagcagatcaagagggattagacgaagcctacaataatcaagcaaaggcttaccggaacatttttgatcggattggcttaaactataaagttattctcgctgattcgggaacaatgggtggtaagaactcacaagaattctctgcaccagctgaagtaggggaagacataatcgcttatactgatggagattacgctgccaatattgagaaggctgaaagtaaatttaccggtgtacaacaaacagcagttccggcaccaatcgagaagaaggctactccgggtgctcatacggtatatgaagctgcagaaagtttagatcttgaccctaatcaagtaattaaatcgatgctttacattgctaaaatgagtgaagatgaataccaaccagtcttagtattaatgcgtggcgacgatgaagttaatgaagcaaaggtaataaatgctcttgattgtgaagaactagaattagctacagaagaagatgccgaaaagtacctcaatgctcatccaggatcacttggacctgtaggagtaggagaagaagtaaaaattcttgctgataattatgttaaggtcttagttaatatggcatgtggtgccaatgaagatggttaccactatgttaatgctaatattgatcgcgacttccgcgttgatcagtttggtgacttccggaatgttaaagaaggagaaattgctcctgatggtcaaccacttaaatttactcccggaattgaaattggtcatatctttaagttgggtactcattactcaagcaaacttggtgcccaagtccttgatagcaatggtcggttgacagacgtaatcatgggaagttacggtattggtgtaacccgtctattgtcagctgttgcagaacaaaatgctgatgaaaatggtcttgtctggcctgatagtattgctccatttgatgttcacgtaattccggttaatgcgaagaaagaagatcaaatggcaatggctgataagatcgatcaacaattaactgaagctggttatgaggtattagtagatgaccggaaagaacgagcaggggttaaatttgctgattcagatttgattggtattccaattcgggttactgttggtaagaaagctcaagatggtattgttgaaattaagatccgtaaaactggtgaaactgttgaagttaaacaggaagagctagtaaatacggtgggaattttactaaagcaattgaacgaggaaaaaaacaaataatttaaactaatgtggctgcgatgttaagataagtaacgttactcgcaccacatttttaagtaggaggattagaacgtgggattaagtcgccaagaattatttggaaaactattagaacaaattcactttccagaaaaagacaattctgcattcagaaatgccgcagttcaatcagttgttgttcataaaaagtctcggcaatgggaatttcacttaatctttaataaagctttaccgtatgacctatttacgcagttcaatcagagcttacagctagggtttaaagatattgctaaagttagtttaaagattagtactcccatgacagaacttgatgaatcacagatagctaattattggcagttcatcattaataaggcaattagtgatacaccaatgctccaacaagcttgcttacaaacggctcctgaggttaaggatgggcgtgtgacgctggttgtcgaaaatgaggtaattaaagacttactagcacagaaagcattagataagattgaaaaatcataccaagagctaggatttcctaaatttaggattcatccgtttgttgaccagtcagcctcgcaagcaaaaattgaagaattaaaggctaaacacgagaaggccgatgctgcacttgctgccaaggcggctgcccggatcaagaaaaatgaggccgcaaagaagacagcaaagaaaagtgcaccagtcgcccctgctgatggcccagtccaacttggccggatgattgatagtaagcagaatgttattcaaatgaaagacattgagggggaagaacgatccgtagttgttgaaggatatgtatttaatgcagaaattcgcgaactacgctcaggtcgtcaattattaacgtttgaaattacggactatacttcttctttttctgtcaagaagttctcacgtaacagtgatgaagaagcacaatttgccaatatcaaagcaggaatgtggttgaaagttcgcggacctgtacaagaagatacctggatgcgagacttggtaatcacggcttatgatgttaatgaagtaactcatatagcgcgtcaagataaagctcctcaagatgataaacgagttgaactgcatacgcatacaacaatgagtcagatggatgccactaattcgattactgagcttgcaactcgtgctcataagtggggacatccagcaattgcggtaaccgatcatgggaatgtccaggcttttccggaagcatttagcgtggcccaaaaaacgggcattaaaatgctatatgggatggaagctaatgttgttgatgatggaattccattggtatataacgagaatcatgaagaactcgctcatcagacctatgtcatttttgacgtggaaacgacagggttatcagcaatttacgataaggtaattgaattatctgcagttaaaatgcaagatggaaatgtcttagaacgttttgatgaattcatcgatcctggtttcccgttatcagaacaaacaactaatttaactagtatcaccactgaaatggttcagggttcaaaaactgaagaagaagtttttcagatgtttaaggacttttgtaagggctgtatcattgctggtcataacgtttcatttgatatgggttttatgaatactggctatgaacgtcatcaaatgggaaaaatcgcggaaccagtaatcgatacattaccactggcgcgattcttatatcctgatatgcgaggataccgattaaacacacttagtaaaaaatttaaggtagcattggaacatcaccaccgtgctaactatgattcggaagctacaggacacttgctttataagttcttgaaagatgctgaagcccgttatgatgtgaagtatgtggatgatttaaataagcatatggaagaaaataatgcttaccgtcatgcgcggccttttcatgtaacgatttttgcacagacccaggctggcttgaaaaacttatttaagttagtatcactatcaaacgttgaatatttttaccgggtaccgcgaatcccgcgaacagtgctgacgaaatatcgtgaaggactgcttttgggaactgcttgttcatcgggagaagtatttaccgcgatgatggagaagggttacgatcaagcactagaaaaggcgcgctactatgattttattgaagttcagcctaagccaaactatgcaccgttgcttgaacaacacgtgattgcagatgaaggtcacctcgaagatatcctcaaaaatatggtcaaactgggggatgagttggaaaaaacagtggttgccactggagatgtccattaccttgatccacatgatggaatttaccgtaagatcctgattaactcgcaaggtggtgcaaacccgttaaatcgaactgagcgtccagaagttcactttagaacgactgatgaaatgctaaatgaatttgcttttctcggtgaagaaaaagcccacgaattagttgtggaaaatagtaataagatagcagctgagattgatgacaatattcggccggtaaaagataaactttatccaccgcatatgaagggggccgaacaggaaatccaagatcggacatggaatactgcgagaaaatggtatggtgatcctttgccacaactagttcaggaccggattgaattagagttgaacagtattgttaagaacggtttctctgttcactatttaattgcccaacgactagtagctaagtccaataaagatggatacttagtaggttcgcggggatctgttggttcaagtgtggttgcaacgctttcgggaattacagaagttaacccgttgccaccacattaccgttgtccaaattgtcaatttacccacttctatacacaaggggaatatagttcaggtttcgatttgccagataaaaaatgtccaaagtgtggcactctaatggtaaaagacggtcatgatattccattccaaactttccttggatttaaggggaataaggtgccggatattgatttaaacttctccggtgactaccagccaattgcccataactatatgaaagttttattcggtgaaaaaaatgtattccgtgccgggacgattggtacggttgccgataaaactgcatatggatatgtgaaagcttacgaacgagatacagaaaaggaatttagaaaggcagaggaggatcgcttagcaaaaggagctacaggtgttaagcgaactactggtcagcacccagcgggaattattattgtccctgatgatatggatatttatgactttacacctgtacagtatcctgctgatgaccaaacagctgcctgggaaacaactcactttgatttccactcgattcacgataatattcttaaaatggatattttggggcatgatgatccaacgatgattcgtgccttacaagacctatcaggaattgatcctcaatcgattccaatggatgatccaggggtgatggccttattctctagtcctaaggtattgggtgtaactgaagaacaaattcaaagtaaaactggtacactaggattgccggaattcgggacgcgatttgtccggggaatgctggaggatactcatccgaaaaactactcgcaattactacaaatttctggtctttcacatggaactggggtgtggctagataatgcccaggaactaatcaaacagggaattgccactatcgctaatgtgattggttgtcgtgataacatcatgaccgacttaatccactatggaatggactcagaaatttctttccaaattatggaacacgtacggaaaggtcgcggaattccagacgagtggcaagaaaagatgcatgaagctaatgttccacaatggtatatggattcatgtttgaagatcaagtacatgttcccgcgggcgcacgcggctgcttatgttttgatggctctgcgaattgcttactttaaggtttacttcccgttagtttattattgtgcattcttctctgtgcgcgcagatgactttgatgtagttgcgatgtctcacggtaaagatgcggttaagcaacggatgaaagaaatcaatgataagggaaacgatgctagtgcaaaagagaagaatctcttaacaatccttgaactagctaatgagatgctggaacggggcttcaaatttaagatggttgatattgaaaaatcagatgcctccgattggttgattgatggtgattcattaattgcaccattccgagcagttcctggattaggactaaacgttgctaagcaaattgttgccgcacgtgaagaacggccattcctttctaaagaagatttggcagagcgcgggaaggtttcgcagacgctgattgatttcctcaccgataatcatgtattagataagctgcctgacgaaaatcaacttagcttgttttaaggaataacaatgaaaacatgcttcattgcttgccagtagcgatgttacatgctacaatagattatggtaaataactcgtgggagtgagcagagatgctcgctctttttattgcaaataatggaggtgacacgtttgagcagtgttgtagaaactgtaacagatcttgtaacgccgattttacaggaccatgatttttacttatatgacttagagtttgtaaaagaaggtaaaagctggtacctccgcgtttatattaataaagacggtgggattacgctagaagattgcgcacttgtcagtgatgaattaagtgaagcattagataatgttgaacctgatccaattccacaggcttactttttagaagtttcctcaccaggtgctgaacgcccactaaagaaagaggaagattatcaacgagcaattgaccattacattcacatctctctttaccaacagattaatggtcaaaaggtttatgagggtaccttaacgcaattatctgataaagaaattacgttggattatttagataagactcgtcatcggcaaattacgattgatcgtcagaaaattgcccaggcccgattagcgattaaattctagtattaaaggagtgtcgaaaggtgagtaagccaaaaattaacactgagatgattggcgcccttgattatcttgaaaaagaaaagggtatcaagaaagagattgttattgaagcgttagaacaagcacttgaatcagcatacaagcaaaattacggtgataagaatgttgaagtagaattcaattcattgactgggaatattaaagtctacgctgtaaaaacaattactgatgatgaagaagcagtcgaagcagatagcaacgaatttatgagtttagctgatgcacggaagcttcctcatggccaagggtatgatattggtgatgaaattcgcgaagaagttactcctcgtgactttggtcggattgctgcccaaactgctaaacaagtggtaatgcaacgtctccgtgaagaagaacggaaaattatttacgacaggtacaagacttatgaaaacgagattatcactggtgaagtttcacgagaagataagcgtttcacatacgttgatttaggagatggcgtagaaggtgctatgggctttagagataagatgcctaatgagcactaccatgtccatgatcggattcaagtatacgtaacgaaagtaaatgacgatcgtcggggaccacaaatctttgttagccggactgctccagaacttttgaagcgattatttgaacgagaagtgcctgaaatcaaggatgggactgtcttaatcgaaaatattgctcgtgaagcaggtgatcgtgctaaggttgcggtatactcaaatgatcctaatgttgatccagttgggacttgcgttggtccacgaggttctcgtgtccaagcaatcgttaatgaacttgatggcgagaatatggatattgtggaatacgttaaggatcccgctaagtttatcgctaatgcgttgaacccagcagaagtacttgatgtaatctttaacgaagagaaggcagcaagcgaaactgaggatagcgaaggagaagaaacgactgaaggacaaacagaacgttcttgcactgtcgttgttccagatagccaattatccttagccattggtaagcggggacaaaatgctcgtctcgctgctcgtttgactaagtacaagattgatatcaagtctgaatctgaaatggctgaaaatgatcaagaatctgaagaagtagctgattcagaagaaaatattgacaataacgaagaataactaaaaattaagcagcggggtgaaaataatgaaaaagagaaaaataccgatgcgtaaagacattgttaccggtgaaatgatgcccaaacggcaattaattcgggtagttaagaataaggaaaatgaagtatccttagacccaactggtaagaagcctggtcgtggagcatatgttgcagtagatgtggatattgcaaagcgggccaagaaagaaaaaacttttgaaaaggcttttcatgttcaacttgatgaatcattttatgatgaattaatcaagtatgcagaccacctacaggcacgacaagagttatttggtaatgatcaaaaataaagaacaggtcttaaacctccttggaatcgctcggcgcgcccggcaacttcaaagtggggaagagattgtcttaaaaaatattcaaactaaaaaggcaaagtttgtattcctagcttcagatgctggaaaagctagtgcaaaaaagattactgataaatgtaaattttatggcattcctttttcaaccgatttcactagagaacagcttagccaggcaacagggcaagcacgaacagttttttgtgtaatgcaatcaggttttgcaaggaagtttgaggaactactaactatgagataaggagtgtgagcatatggccaaagagcgaatttatgaattagctaaggaattaaaaatgcctagcaaagacttagttaatatggccaatcggcaaggaatgggagttaaaagtcacatgtcttctgttaccccagatcaagcgcaacaattacgtcaacttgcaaagggtggacaaaaaacaactaataatcaacaccaaccagtaaagaaaaatgatggtcacaataagcaaaataaccatcaagcacaaaatcataatcaacaccatgatcatgataaaacgcaaaatgagcgtccacaaaagaaaaacaatagccggtcaaacaatggaacaaaagataataatcaacaccaaaacaacggtggtcgatttggcggcagcttgaataacgatcaaggccgtaatggcaaacgctttaataagaaaaataagaagaacaagaaacacaataagaataagcggttacgtgaggtagctcataagcaaccaacacaacgaaaagataagccgcttccagaagtattagaatatactgatgggatgaatgctcaagacttaggaaagatcttacaccgttcaccagcagaaatcgttaaaaaattatttatgcttggtgtaatgatcaaccaaaatcagtcacttgataaggatacaattgaattattagcaactgattacggtattgaggctaaggaaaaagttcaagttgatgtttcagacattgataagatgtttgaagatgaacaaaataatactgaacatcaagtaacgcggccagctgttgttaccgttatgggacacgttgaccatggtaagacaaccttgcttgataagttgcgtcactctcatgttactgaacatgaagcggggggaattactcaggaaattggtgcttaccaagttcactataatgatcaattaattacgttccttgataccccaggacacgctgcctttactgaaatgcgtgcacgaggagctaatattactgatatcacggtccttgttgttgcagctgatgatggagttatgccacagacagttgaagcgattcaccacgcgcaagctgcccaaacaccaatcattgttgcagttaacaagattgataagccaggtgcaaatccagatcgtgtaactgaagaattagcaaagtacaatttaattcctgaagactggggtggagatacgatttttgttaagatttctgccaaatttggtaagaatcttgatgaattgcttgatatgattctactccaagctgaaatgttggaattgaaggctaatccagatcaaaatgcagctgggtcagttgttgaagcccgtcttgatcaaggccggggatcagttgctactgttttagtgcaacaaggaactcttcatgtgggggacccaattgttgttggtaacacatttggtcgtgtgcggacaatgacaaatgaaaatggtcgtcggattaaagaagccaccccatctactcctgttgagattactgggctaaatgaagtaccagaagctggggaccgttttgttgtctttgatgatgaaaagactgcccgtgcagcaggtgaagaacgggctaaacgtgccatggataaggaacgtcaaaagacttctcacgttacattagacaacctttttgctactatgaagaaagggcaaatgaagaccttaccaattatcattaaagccgatgttcaaggatcagttgaagctttaagtcaaagtcttcaaaagattaaagttgacggtgttcgtgttgatattattcaccaagccgttggtgccattaatcaaagtgatgttaccttagctgaagcatctaatgcggttatcattggctttaatgtccgtccaactgccgtagctaagacattggctgattctaatagtattgatattcgtcttcaccgtgtcatttacgatgcaattgaagaagttgaagatgcgatgaaggggatgcttgaaccggtatacaaggaagaaacaattggtcaagtagaagttcgtcaaatctataaggcatcaaaggttggtacaattgccgggggaatggttacatccggtaagatcactcgtgatgcaaaggttcgcttagttcgtgatggcgttgttatttacgaaggtgaactaggtagtcttaagcgcttcaaagatgatgtcaaagaagttaagcagggttacgaatgtggtttgacaatcgaaaactacaatgacattaaggaaatggatgttattgaagcctacaagatgaaagaagttccagttaagtaaaagctgaggagagataaagatgccaagtaaacaatatcgagtagatcgtttagctcaagaaattcaaaaagatgttgatgaaatcttgttaaaacgtgttcgtgatccacgtgtacaaaacgttacaattacaggtgtggatgttactggtgatctccagcaagcaactatctattacagtatcttgtcagatcttgcttctgatgccgaaaaggcacaggctggattagataaggcgactgggttaattcgcagtgaattaggtgcacgtcttaatatttttaagactccagaaattaaatttgtaagagacccatcagttgcttacggtagtcgaattgatcaactcattaacgacttacacaaaaaagaaaaataattagcaaaaaggggagcgagacagaagtcacttgtgagttcgttttcgacgcaaagctagcctctgtgagctcccgcaagcaacaataggcctccaacgttcggttttaccgagcgatggaggccattgttgtactgcgttatttgtcttttgtgaaagtaacttgacttatatcacagccccttggaggaataacgatggatggaataatacccttatataaagaacgtgggatgactagttttgcctgtgttagtcgactgcgacaaattttaaaaactaaaaagattggtcattcaggaacgcttgacccaggtgtagcaggcgttttaccaatttgtgttggaaatgctaccaaagttgttgactatttgatgcaatcaggaaagcaatatcaaggtgagcttttaattgggtttgcgactactactcaagaccttgatggagacaaaattgaagaaaaagtagttgcagatgaaattcccactagtgaaatactatcagccatgaattcattaacggggacaataatacaaatcccaccgatgtattcggcggtaaaagtaaatggaaaaaagctttatgaatatgcaagagctggtgaaactgttgaacggcccaaacggcaagtgactattagcaaatttgaattactaagctcaaagtatgataagaaaaacaaacaacaacgaatccgctttaatgttgaatgtagtaagggtacttatattcggacacttgttgttgaccttgcacgtaaactaggatatccaggagtaatgagtttgttaacgcggttgaagagtggaggctttactcttgatcagactctaagtttagatgacgttcgcgatgctgttgcgacccaaactctccagcaatacttgtatcctttagattatgctttgaaggactatccgcaattaacgattcaagtggctcaatggaaaaaggttcaaaatgggggatggctttctccaagtgaacttaatactagcgagaaggaaattgtgttatcatttgatggacaagtaaaagcactgtatcattttgatccgaaaaataaaatgtataagccaactaaaatgtttgcagttaattgaggagtgtaggagttgcaagttataaaaattcaccatcctttggcaaaaagactaattcctgcggggccaattgtacttgcaatgggtttctttgatggtgttcatcgggggcatcaagcagtaatcaaatgtgcccgtgaaattgcccgtgaaaaaggattgccattagtagttttgacgtatgatcatgctcctggaattgtttatcgtcaatataagggcggctttaaatatctatcaacggtcgataggaagcttgaattattaaatgatcttgatgtcgatcgggtttatctaataagttttacatcatcgtttgcaagcctttcccctcagcaatttgttgatgagtatttggtaggttttcatgctcaaacggtcgtagcaggttttgatcatacttatggaaaagaagatattgcatcaatgaagttgcttcctaagtatgcagcgggacggtttgaagttgtaactgtgcccaaatttactgaggatggaagtcaagaaaaggtcggttcgcgagaaattcggaaattaatcgatgctggtaatgtggaagcagctaaccaagcgttagggtatccttatcaaacaactggcttagtagttcatggcttagctcgtggacgaacacttggttttcctacgatcaatgttgagcatccagaagaggagcgaattcctggaattggggtctatgccgtcaaagttaagctcagtaagaagtggtatgacggtatggcaagtgttggccacaacataacatttggcgatgctaatcaattaacggttgaaattaacttatttgattttcaacaaatggtgtatggcgaggaagtagttgttcgttggtatcagtaccttcgtggcgaagaaaagttcacgggagcggatgcattagttgcacagatgaagcaagatgaacaagacgcccgtcatattttagaaaaatataaataaaagaggtttagattgatctttcgtggcaattgcaccaccaagattcatcaaacctcttttttaatgccgacttccccgatgactggtagtctgattaattttatggatgtttcgttcaaatttgaatccgccatcagtcactaatttgaaatgccgcattttcccgttaaaaggctggccgtttaagcgcactgttgtccagttacgcataatttcggtcattgaagcaagtgccttaagttgattaggattgttctccttaattgcttcgtctttaatatctgactgcaagcgatagattaggttgttgtgatattctaatagttcattcgtgaggggcgcattacggtatttattaaataacttctgaattaataacattgcttcttgagtattctggggttgaatatagcgatgttctttatgtttcatggataaagctcctttaaaaaattgtttgacgtttcttgacttttagggtagtaattggtatattatacagtgtgtttagcacttgaccctaatgagtgctaaaaggggaagtgatatacgatgctaacacaacgacagaaaaagattctgcaagcgattgtacgtcaatacacatcaactggtcaaccggttggatcaaaacatttagcagaaaagttaccttttaaggtcagttcagcaactgtccgtaatgagatggcggttttagaggacaatgatttgatcttaaaagagcactcttcatcgggccggattccatcgaaacgaggttaccggtattatgttgataacttgcttgatccacaagcagttactgataatgacctggtagtaattcaaaactcacttggaaacggttttcaaaagattgacgagattatttcacattcagcagatatcttatcaaacttaacttcatatactgcttttacactaaagcctgagcaagaaagtgttcgtttgagtggctttcgagttgtaccgctggggaatcataaggttattgcgatcttagttaccgacagcggtgaggttgaaaatcagtcattcactttgccgccggacattgacacagatgcaatgcaggcagtaattagaatgattaatgatcaattagttggtttgccgctatcagaagtggtaaaacgactaaaagatgatatcccactccaggttctgcattatatgcatagtcccgatggtttccttgacatttttgataatgtcttatctcaagcagcacgtgagcggtttttcgttggtggtcgattgaacttactggattttgcaagtactcatgatccccacgcaatccaatcactgtatggcttgttagataagaacgacaacttatcgaatatcttggattcgacacttacctcagataatggagttaatgttaaaatcggtcaagaaatctctaagaataagcttcttgatgactatagcttgattactgcaagttataatgttgaacaatatggacgaggaattattgcagttcttggtccaacaaggatgccttattcacggacgattggaattgtaaatgcctttcgccaagaattagcaaaacggctattagatttctaccgtcactattatgattcataggaggcgagttaattggccaaggaaaaacaagaagaacaacaaaaacaaactgcgcctgaaaatgaaaaggcacctaaaaaagatataaaaaaagaggcttcagataagaagggtgatcaaacttctaaattaaaagaagagatcgctgacttaaagaagcagctcgctgataaagatgacaaatatttgcgagcagaagcagaaattcaaaatatgactaatcgttttaataaagaacgggctcaaatccttaaatatgatggtcaggatttagcaaagtcaattttaccagtgcttgataaccttaaacgggcattagcaattgaagttgtagacgataatggcaagcaacttaaaaaaggcattcaaatggtccatgatcaccttgtaaaggcattaaatgatcatggcatcactgaaatcaaagctgatggtgaaacatttgatcctactcttcaccaggcagttcaaactgttccggtcgaagaaggtcagaagcctgaaactgttgttaatgttcttcaagcaggatatcaactcaaagaccgggtattacgcccagcaatggttgttgttgctcaataaatttgtgagagaaggaaataaattatggcaagtaataagattattggtattgatttaggtactactaactctgcggttgctgttatggaaggtaatgaacctaagattatcaccaacccagaaggaagtcggacaacaccatctgttgtttcatttaagaatggtgaaactcaagttggggaagtagcaaagcgtcaagcaattactaatcctaacactatttcatcaatcaagagtcacatgggtgaagcaggatacactgttgaagttgatggtaagaaatatactccacaagaaatttcagcaatgattttgcaataccttaagaaatatgctgaagactacattggtgatactgttactcaagcagttatcactgttcctgcatacttcaacgatgctcaacgtcaagctactaaggatgccggtaaaattgcgggccttgatgtaaagcggattattaacgaacctactgcttcatccctagcatacggtcttgacaaaaaggacaaagatgaaaagatccttgtttatgaccttggtggtggtacattcgatgtttccattcttgaattaggtgacggtgtcttccaagttctctctactaatggtgatactcatttaggtggggatgactttgaccaaaagattatggattggttaatcgatggctttaaggaagaacacggtgttgatctttctcaagataagatggcgcttcaacgtttgaaggatgctgctgaaaaggctaagaaggacttgtctggtgttcaagaagcacaaatcagcttaccatttatttcagctggtgaaaacggcccattacacttggaaaagacattaagtcgggcacaatttaaccaattaactaacgatttggttgagcggacaaagcaaccggtattgaatgctttgaaagatgctgatcttacttttgatgacattgatgaagttatcttaaatggtggatctactcgtattcctgccgttcaagaaatggttaaggaattaactggtaaggaacctaaccactcaattaatcctgacgaagccgttgctcttggtgcagctattcaaggtggggttcttactggtgatgttaaggatgtcgtattacttgatgttactccactttcacttggtattgaaaccatgggtggtgtcttcactaagttgattgaccgtaacacaactattcctacttcaaagagccaaatcttctcaactgctgctgataaccaaccagctgttgacattcacgttcttcaaggtgaacgtccaatggcagcagataataagactttgggtaacttccaactaactgatattcctgctgctcctcgtggtgttcctcaaatcaaagttacatttgatatcgataagaacggtattgttaatgtttctgctgaagatcaaggaactcataagaagcaaaacatcactatcaagtctaactcaggcttaagtgatgaagaaattgaacggatgaagaaggatgctgaagagcatgctgaagccgacaagaagaagaaggaagaagttgacttgaagaatgaagttgaccaagaactcttccaagttgataagactttgaaggaagttaagggtaaagttcctgaagatgatatcaagaaggctgaaagtgctcgtgacgaattaaagaaggctaaagaaagcggcaaccttgatgaaatgaaagctaagaaggatgctttgaacaaagttattcaagaccttagcgtaaagctttaccaacaagctcaaggtgcacaaggtggcgctgctaatggtcaacctggtgatagccaacaaaatggtaatgacaacggtaatgatgacaatactgttgatggtgattttaaggacgttacaccagacgacaagaaatagcctgcggtaaacagtcttaaaatgttagtgtaaaagccaaaggccagaaaaaaggactttggcttttactttcgtttgctggctgtggtataactaaacaagcaataaagtaatgaggtatttattatatggcagaacaagattattatgacattttaggtgtctctaaggatgcatccgaaaaagacatcaagcgtgcatatcgtcggcttgcggcaaaataccacccagatgttaaccacgagcctggtgcagaagaaaagtttaagaagattaatgaagcatatgagacattgagtgatagtcaaaaacgtgctcaatatgatcaatttggttcagctggcccacaaggtgctggcggtcaaggctttggcggctttggtggtggtcaagcttattctaactttggtggcggctttgacgacatctttagtcaattctttggcggcggcggtcgtactcgtcgggacccaacagccccgcgtcaagggcgtgatttacaatatgcaatgactcttgattttatggatgcggtttttggtaaaacaactactatcaagtatgaccgtgatgcagaatgtaagacttgtcatggaaccggagctaagcctggcaaatcgccaataacttgtccacggtgtcatggtgccggagtgattacgagcgttcgtcaaacaccgctaggcaatatgcaaactcaaactacttgtccagaatgtaatggaactggaaagattattaagcccgaagatcgttgtgatacttgccatggtgcaggacatgttcacgaacgtcatgagctagaagtgaaggtgcctgccggagttgatgatggtcaacaaatgcggctccaacaccaaggagacgctggtgagaacggtggcccagccggagatttgtatattgtcttccgggtaacaccaagtcgagaattccgtcgcgatggttcaacaatttatgttgatcgtgatatttcgtttgctcaagcagccttgggagacgaagtaaaagttaaaacggttcatggtgatgtcaaccttaaaattcctgctggaacacaatcagaaactaatttccgcttgcgtggcaagggtgttccacaccttaacggtaatggtaacggggatgaacatgttactgtccatgttaagacacctaagagccttaacaaacgtcaacgtgaagcaatgttagcttttgcggctgctagtggtgaagatgttaagggtgtgaagaagacagttcttgataagttacgtgatgcctttgaggataagtaaataatttttatgaagcaggaaaagcttaatatttttcctgctttttgtatatctagtagaaggtttcccattctaaacgaggatttggtatactagataaagaatattcgttgaaagtgagtctttttaaatgaacctagaagaaatgaaagagcggcaaaaacacattcggaatttctcgattgttgcccacattgaccatggaaaatcaacgcttgctgatcgtattttagaaatgactgattcaatcagcaaacgtgaaatgaaaaatcagattcttgatgatatgcctctagaacgagaacggggcattacaatcaaattaaatgctgttgccttgacgtatcatgctaaagatggtgaagattacattttccatttaatcgatacaccaggccacgtcgatttttcttatgaagtatcacggtctcttgctgcctgtgaaggtgccgtcttagtagtcgatgcaacgcaaggagtagaagcgcagacgcttgctaatgtctttttagcgcttgacaatgaccttgaaattttacctgttatcaataagatagatttaccttctgctgatcctgagggtactaagaagcagattgaagatgaaattggtttagatcctgatgaggcagttgatattagtgctaagactggaatgggcgttgatgaagtcctggaaaaaatcgttaaggatgttccagcaccaacaggagatttaactgcgcctttgaaagctcttatctttgattcaaagtatgatgattatcgtggagttgtccttagtgtccgggttgttgaaggaactgtaaaaaaaggtgaccgaattaaattaatgaacggtggtaccgaatatgaggtagcagaagtaggaattaactctcctaaaccattggcccgtgatgtgttaatggctggggatgtaggttacattacggcggcaattaaagacattaaagatacccgggttggtgacacggtcacaagtgcggataatcctacagataagccgttagaaggatatcggcaaatgacgccaatggtatatgctggactctatccaaccgataatgctaaatttaatgatttacgtgatgcgttggaaaagcttcaacttaatgatgcagcattaaccttcgaaccggaatcatcgcaagcattgggatttgggttccgttgtggtttcttagggttacttcacatggatgttattcaagaacgacttgaacgtgaatttaatcttgatttaatcacgactgcaccatcagttacttatcatgttgaattagcagatgggacaacaaaggaagtggaaaatccggctgaaatgccggacgcttcttccattaaagcgattaaggaaccgtatgtccgcgcctcaatcatggtccccaatgattatgttggcccagtaatggaactttgccaacggaaacggggagactttgatacgatggaatatctaagcgatacccgggtaaacgttatttatcatattccgttgtcagaaattatttttgacttctttgataagttaaaaagttctacacgaggatacgcttccttagattatgaaattgatggctaccgtccaagtaatttggttaagattgacatcttgcttaatggcgataaggtggatgcattaagctttattgctcaccgtgactttgcggcagaacgtggtcgagaaattactgctaaattaaagaagatcattccacggcaaaactttgaaattccaattcaagcagcaatcggttctaagattattgcccggactaatattaaagcctaccggaaagatgttactgcccgtattcataccggggatccagaccggcgtgccaaattattagataagcagaaacgtgggaagaaacggatgaaggctgtcggaaaagttgatattcctcaggccgcctttatggccgttttgaagactgatgagcaattggacgagaagtaaacgttgatgtaaaggcgtttctaacttgctggatttcacaaagtagaccaatttatataccaattaaagtgttttgcccaccatttgcccacatgaagtaccttcgtgggcaagacgcaagatactttgtgggcaaatggtgggcaagatttacattttagctatttgatcaagtagatttgctgtttgatgtttcttcttattgctaagatggacataggtatctagagtggtggcaattttgttatggcccaatcgtacttggacctctttagcagatgcacccgcttctagtaacatggttgcgtgggtatgacgcaaactatggaaattaaatgggaaacctagctctttagtgacggtacttgcatagtacttaatcgaattgggagttacaggtttcccattttcttttgtacatacaaagttagattcatggtaatttttaccatatcgtaaacgattttcattttgtagtcgccgctgaactttaagcgcatgaataagttgatcaccgattgcaattgttcgataactggcagcggtttttaattttccaagtcgaacatcagttttggaatattgtttcatttgctgagtaacattaatttcagcatctggtaaactaacattatcccattcaagaccggctacttctccacgcctcattccagtataaaagctgattaaaaggggaaggtgaaatgggtggccaagaggaaattgctctaaaagttgattaaattgttgtagggtaataatttttagatcttctcgtgtagttttaggatggttatattttggctgccggacatattctgcaggtgattgagtaagaatatgccagggatggactgcttgtcgaaaaccttccttgataaccataagaataatttcgacagtatgaccatggagtcgtgagtgatcaggcttgtattcggtagagtctgcaatcttattaatagtcttttgaattaattctggagtaactttagataattggtaaattccaagggtaggttgcacatatttatccaagacatgccgataattcagctgagtatttttagataagttagtcttaacataattgtcataccaaaattcaaagtaatcatgagttgaaatcttatcagtgttggtaactgctcctgtattttcataaagctctaaagcaacgcgtaatcggtgcattgcttccttgtaagaatcgcctccgactcgttcatactgtcgtctttttccgtctttgtcagcaatatcaaagcggtagtaccattttttaccacgctttctaacattaccattcatagtaaaactcctttctgttataataaaaatgtactgagggtgtacttcacccctagtattgctattgtgacctcaatgatcgaccggccaaagttggatcattggggttttaatgtttaaaatttaatagtatattgtaggtgtagcacttttgccttcattgattgtcatttgagtaacatgtaaaggaaaaatattgttcttcatattaaaacaattttttccaggatcgtaatccttgataaaattcattttcttaaatgacattaaagtttcatgaactacttgccttaggagtgctagatgtaactctttgaagggaatccctggcatatttggcattttagttgcttgtaaagaatatatatcattctttaagttatagtatttttcatttagctcagggtcaatgtgagctccgccatctttatttacaatgaatctaacaagttcttttctggtgaatgaggtatctgaggcaattaaaattcttccgttccaccaatgttcaaaactaatatagtgaccaatttctaaatttttttcatagcatgatggaagataaacatatttgccagcaacaaatgcattagtaacacttcctccatatataattggcttttcaccaaattgacaagtagacaaaaattgatctttattaacttccggaataaggtttattaatatatctccatagctttgttgatagaataaagttcgtaattgtggagtagccatttttatagctgttctctctccactatcgtatagctttgctgcataatttaagaatttaagctgttcaataaaagcatcataatattcgctttgtgatcttcttatttttctgttaaccattgaggtgactcctttgaataaaaatattattattgttaatgataaaaaagatattgataatattactgaattggaatctttttattcagaatttccaactgatagtaatataggcattgatgagctaaagacactgatgactggaaaagccttaatagatgtatctgatggtgagtatatacattggttacagctagataaacatgctttaagatttgcaaagactatactagaaaaataacttgtaattacaataatttcatcccttgttgcagcaggggatgttttttatttagttgttgtcatcgtgcattacatcatagagtgattcgccatcgtaagacatgtataaaactttatctgtgttttcaggattaacaattgcaataggtgtcttaatatgacaatcatcataaattgtttctgataagtcatcgattgatttggtaagcttgttccaatcgtgttcagactcatcaccgtcaagaacagcgatcatttcatcttcaaattcttcatcagtaggtttaatagcaataacgtcattttctttatcgtagtaaacatctgcagaatcaccatattcttcttgcatgatagacactgccttgttaattctagaacgttttgacgcttgaactactgtaatattgctactattcgtattaacaacaaccgtcgtggtagcgagggaaaccccagcaaggcccactgccaacataatcttaaaacctttattcataaataaactcctccgatttcaacttttaacgtcaatcagtatttggacgtacatagttacttgttctcttttacaagtttttccaattactttctcatttatttataactatctgttaaaaccataatggcatttttaccaaaatactttttagcaaaccaactattagcttgtgttttttcaatttcaagacgaccattaagctgacctttaatcgttataggatcaccaacagcaatgcgttttttatgcttgcgaccttgtaaaacggtgaaataatagttagtactttcaggagtattagtgaaaattattcgttcattatggtgtttatcatagctaatactttgtacatagaatttctttattgatacatcggtaaataaatctgagtcatcatactgattcatgttattcacatcaaatttactagttatatctggataatcatcgtttgttgatgctgcatatacataattattatttgctagtgaagtagtaaccgttcctccacaaattcctaacaagctaagtgcgattatgtttttgaacttcataagtaaatctccctaacattcagctttttacgtcaatcagtatttggacgtagatcattatttaatgctccatgaaacgtgaaccgccttaccaataattcgacctggaatatctttatctaagataattgggccgaattctttattatctggcattagcataattagatttccttagtgcttaacacgtttcagtgtcgcttcattatcaccatcaacgagagcagcagctatttcaccatcttccactgtgggctgttctctaatggttacaattgaaccgtcgtgaatggttggttccatgcttttacctttgcaacgcagagcaaagaggttaccttttgggaaaaatctcttcaacgtaaccttcaatattctcttcagctgtgataggatccccacaggcaatttcgccaatgaaggggatgctaacatgctgaaatttatctcctaatggataaattatattagttggcactttagaattgctattttttcttggttaatgttatatcccatcagccaaccttcatcaacatttaaagcttttactagtgaatgaagcttgtcttgcttggcctcgtattttccttttagataatcacaaattgaatttcttccaatatttactcgtcttgctaattctgctgttttattttagcacagttttatgtacatatttaaaagcgtacaaaaaactgtatagctatctctgactatgataatgattagcctgtaatatagtaggtcaggaaaaatgatcaaaaattaaaaggaagtcaaagcgatttgttttgattttgctattccagatatattaatcggcatttcttttttaattaaatgaagtaaggacagaatcacaaattttatagaattcatgcccatgatcaagataggcaacttgtgcaactgataactcaaaattatgcagtatcattcgattaaacatggtgggtttttatactcgctcaatactgcagtcctcatcaaattagcgtatcatagataatgtaatcgctattatttgaggaggaaataaatatgcaaaataaagatgcttgtacatcaatcatggtcggtaaaaaggcttctctcgatggtgctaattatattgcccgtaatgaagatcgtgtaaaggcaattgaacctaagcaatttttagtaaaaccggcagtaaaagaacgccatgaaacctacgtatcaccttacaacaaagtaactatagccttgccagaagagggaatgcgttatacctctacgcctactcttgaccaaacagccggacctaatgaagaagatggaattaatgaagcaaatgtggcagcttcctttactgagagtgtttatgcaaacgatcgggtgttagcatatgatccatacgtaaaaaatggcctggcagaagactcactttgtactttagtattaccgtatattcattctgcccgtgaaggagttgaatatactggaaaattaattgctgaattgggctcggctgagggaaacggaatgcaatttgcagatgcagatgatatttggtatatggaagtagtgactggtcaccaatgggttgcagttcgtattcctgatgattgttatgctgttactcctaaccaggtagcaattgaagatatcgattttgacgatcctgataattatatgtgggctgatggaattcaagagtttgttgaagaacatcaattaaaccctgaccatgaccggtgggatttccgccatatttttggtaccagtacacaaaaagaccgtcattacaatacaccgcggacctggtttgctcaacgttaccttagtcctaacgcttcattgggtcaacgtcccgaagattctgaaatgccatttatccgtaaggctgaatttaagattgctaatgaagacatccaatatgttctaaaatcgcattttaatgagacaccttacgacccaatgggggatgctcctgaacgtaagacttaccgggctatctctttatcacggacggcccaatcacatattttacaaatgcgcaatctgaataaatataaaacaagtattcattggattgaattaggggtcccagcctttaacccttatgttccattttttgctaatgctgacgatactgatgaatcatatcgaaatgtaccggaaaaaatgaacttagagtctgcattctggttaaatgaagccttagcagaggtcgttgaaagtcattatcaagaatttatggaaaaagatgaagactaccaaaaagaattaaatgaatgggcacgccgtaaaattgcgcaggttgataaagaagcagctagtcttgaaggccaggcactaattgattatctaacggagcaaaatcatgaaatagcttcccattataatgaacgaacaaaggcactcttctttgaattattaactgaaggctgtgagctttcaaagatgtcatttaagatggatcccaacctttaagcgactttgaatattgacatttttctctttgttattaaaatataattaatataaaatgagagaaggatgaaaatgagaattcaagcaaccgatgaacggcattatctagtagaagtttttacaaaattgggatttaaccacgatgacagtcaattattagcagacactctagttgatgcggatttgcgcgggatctcatctcatgggattcaacgattagcatggtatcgtcggatgattaaagaaggaacgattattcctcaaaataaggctaaaattattcgtgagttaccaggatctgtccttgttgacgctaaccaaaatatgggacagctcgcaacggttttagcgactcaaaaaataattgaaaaggctaagaaaacaggggtggcaattgctgttattcgcaattcgaatcacttcggcaccgctggttactatacaagattagcgttagaagctggattggtaggagttgcccttactaacactcgtcccttggtagtcccaactaatgctactcaggcttttcttgggtctaatgcctttgcgtttggctttcctgcttctccatatccatttatgtttgatggtgctacttgtgttgtttccggtggaaaaattcaagttcatgctaaaaaaggagaaccgttgcccggcgaatgggcagttgataaagatcggcaggtagtaactgatgcgcaagaggcagaagatattcttgccaccgcggcctttactgaaggggaacaaaagggtggaggagttctcactcttggcggaagcaatgaggaaaattctaattataaggggatgggaaactcaattgtaattgaattattgacgggtattttagcccaaggatctatctctgccgatactgttagtggcaaacatgattttagccaatttgtaatggttcttaacccagcattctttggtgatccagaggtattgaagaaagatgccacatcaatgttagatcgaattcgccagcttgaacatattcctggtaaagaaatttgggtacccggtgatcgtgagtaccgtttattagcagaaaataaagaaaaaggtgtcacaattgatgaaaagacctatcaagaaatgaaagaaataggaactgaacttggtattgatgttccttaataattgataaactccttcaaatccggataagcgaaagtggcttacttcggcaattttagcgagtgaacttagaaaaaagggttataaggataaattaatagaagacttccttgatgattttgcacgtgacttgaaaaatgatcaaaaataggtaaaaaaactcccaacgttttactaaacgctgagagttttttagtagcacgataatctatcgttctatttatgaatatggcttagttgttaccttgtaactttgccataccgttcttagcaacttcttccaattgcttagcagagtcggccatagccttcttttcacggtcgttaagtggaacttcaataacctttgcaacaccagaagcattaacaacagctggagtaccgatgtaaaggtcgttgagtccgtattcaccgttcattggggcaccgatagggagaacagaattttcatcacgaagaatagcctttgaaatccgcattaaagcagtggcaacaccatagaaggtagcacctttgcggttaatgatttcgtatgctttgttacgaacatcatcttcaatcttaagtaattcatcttctgaaataccttcatccttagcgatgtcaagtaatggcttgccaccaacagtagcacttgagtaagcagcaaattcggaatcaccatgttcacccataatgttagcaataacatcacgagggtcaacatgaagcttcttaccaagagcaacccgaagacgtgcggaatcaagtgaagtacctgaaccaacaaccttgttcttagggaagccagaaagcttttgaacagcataggtaaggatgtcaactgggttagctgcaactaagaagattccgtcaaaaccagacttaacgattggttctacaacggacttaatgatcttcaagttcttatcaactaattgaagacgagtttcaccaggcttttgtggagcaccggcagtaataactactaaatcagcatctttgcaagtgtcgtaatctgctgagtagatgttcttaggagcggtgaaagcagtagcgtcttcaaggtccattgcgtccccttcagtccgttccttgataatatcaacaatagcaaattcttcagcaattccttgttgagccattgcgaaggcgtaacttgaaccgacagcaccgtcaccaacaagaacaactttttgatgattcttagacataataaacagtctccctttcatcttatgtatacattatttgagatttctctcacagtaatgattataacattccgcagaaaaattactataagattttatagataaattagttagtaaataagcctgctcctaagataatgactgctaaaaggatcgctggccaaagtaaaacatgaattaatgtcccgattaatagaataagaaggattagaccaatgaacttaaccgttaaaaccccaatcttccatagcagccagcagataagaatagcaattaagagactcactattgtaatcacctttccttaaagtattgtgaacatagtatagcatttttttgaaaattaaagtttaaacatagattaaactttggaacgttggtgacctgtgctaaaatatacctatctagggagattaatttaaaattgatcaggaataataatagaggaggtggttaccattctgaatcgaactaagcaatttatgcgcgacaatgatttaatgtataaaaaagagtacattcggccaatgatgacaccccaacacgtatatgtgttccgctttggtaaacacagactaaataatcgggtaattgttcgttattcccatacttggaccggacgattaaaaattaacgagattgatgttcggttgcatcaccaacatcatccccgtattttcttgactgagtccgacttaatcgattacttaagtcatcatttagaaaaagaaaagaaacgcgaacaagaacgaccacatattagtaaagttgataatgaaaatgattagactttattaagttggtatttatcgtgaccatttacttttattgtggtcacgattttattatttaaggaggtcattaaatggattggacagcaataaaggtaataacttctagtgaggctgttgaagcagttagctatattttgacggatatgggagcacaaggcgttcaaattgaagatgccgctgattttgcaaacttacatgagggaaagtatggggaccacggtgaatttattgatccatcatcaattccgcaccgaaaaaatggcgcagcagtatctggatatttcccccaaaacgtatttgttcctgaactattgccaactatccatcaacgagtagcaaaattaagggagtacggcttgaatccaggagaaaatgatgtttcggcagcgaccgtcgataatcaacaatgggcaacagtttggcaaaagtattatcacccattaagagtaacggatcagttaacgattgttccgcaatgggaagaataccagccagcagatcctaaagaaaaattaatctttcttgatccaggaatggcttttggcaccggaactcacccaactactcgtttaatgcttgaagcccttgaaaaaacaattgttggtaatgaatatgtaatcgatgtcgggacaggttctggtgttttaagtattgctgccaagcacttaggagcaggaaaagttgatgcttatgatattgacgaagtagcggtcaactcagcaaaaaagaatcttgcactaaatccggtcgctaaagacgttaaggttggtataaatagcctgttagatggaatccataccaaggcagatttgattgtggctaatattcttgcggaaatcatcgtgcctcttattcctcaagcatacgaaaatcttaaaccgggtggcaagttcctagtttctggaatcattgatgataaggctccgttgattcgtcaaaagttgcaagagcaaggattcataattgatgatgagcagcagatgaaggactggcatggaatgattgcccacaagccaaccgaggtgaaataaatgcaacgctattttgttaatgcaactccagccgatgaagtaacattaccgcctgaagcagcccaccacttgttaaaggtaatgcgcgcagaggttggcacaactgttgaacttgtgttagccgaccattgtgtttaccttgcaactcttagcgctacagaaccaacggcaacattaaaaatcaatcaaaagttagatgctgatagtgaattaccagtttcagtgacacttgcctgcggacttccaaagactaaagagaaaccagaattaattgttcaaaaggcaactgaattgggggcagacaaaattgtcttcttcgatgcggctcgctccattagtcactggcaggggaataagcagaaacgaaagatcgaacgtctgcaaaagatagctgaatcagcagcggaacaatcccatcgaaataagattccccaggttgaatacagtgctaatcttgatcaattattagccaattatcccgctactgaacggatagttgcttgggaagaatcagctaaacagggagaaacaagtgctttagcgcaacaatttaatgcccttaaaccaggagactcgatccttgctgtttttggcccagaaggtgggttgtcggaaaatgaaattgctaaaatgaatgaagctggcgtggtagcagctggtttaggaccacgaattctgcggactgaaacagcgccattatatttcatggcagctatttcatatgcaatggaattgtcataatgtagccggcttacttatggtaaaataaagaacagctttaatcggtgatttaaaactgaatataggtgttgagagagaatgaattttatgaaaaaagcatgggaacatttagacaaaccattatggctagctagtattttaattgggattgtattgacgctcgttgttgataagcttccatttgttacgcgagtggtaatggtagagattgtcttaatccttattaatggtatttttagtatttggtccggttattggatttataagcaccagcgaaaatggggcgagttattcatttttccaatcctttacttgataactgcgtatttctttatgccccgatatacttattattttgcccttgcttacttagcgcttgcgtacttatcctgggcaatgcgtcaacaaaagtaattgaaaggaggtcgtccgatgtcaaaagaaaaggaattgacacatgaagatgttcaaaagatggttagttcttatatgaatgaagaacacgttgctttagttgaaaaggcatatcattttgccgaggtagctcaccatgaccaacgacgtaaatctggagaaccgtatattattcatcctatccaagttgcggggatccttgctaatcttcatatggatcccgaaacagtttgtgcaggatatttacatgatattgtagaagatactggcgcaaccttagatgatattaaagaactctttggaccaaccattgcaatgattgttgatggtgatacaaagcttggtaagattcgttacaaatcaaataaagaacaaatggctgccactcatcgtaaattattacttgcaatgtcaaaggatattcgggtaatgattgttaagcttgcggaccggcttcataatatgcgcacccttaagcatttgcgacctgataagcagcgccgcatctcaaatgaaacccttgaaatttatgctccaattgcagatcgcttgggtatcagtactattaagtgggaactagaagacctgtcattacggtacttaaatccgcaacaatattaccggattgtccatttgatgaattcacggcgcgatcagcgggttgactatattgatgagtcaattaagttaataaagaaggcgattgcggatttggacttaggaccgaatgttgaaatttatggccggcctaagcatatttattctgtctaccgtaaaatggttactcaacataagcaatttagccaaatctatgacctcctcgcggttcgaattgtcgttgactcaattcgtgactgttatgctgctcttggagctatccatactaattggaaaccaatgcctggacggtttaaggattatattgcaatgcctaagactaacggataccaatccttgcatacaacaattattggaccagaaggacgaccattagaagtgcagatacggactcacaagatgcatgaaattgctgaatatggggttgctgctcactgggcatataaagaaggtaagactaatggaatccaacaaactcaggatagtcaaaagctaaatgtcgtcaaagaaatccttgaattacgaagtgaaagtcaaggcacagatgaatttatgcaggggattcagagtgatatatttactgataaggtctatgcatttacccctaaaggtgacgtaattgaaatgcctaagggatctggcccacttgatatggcttaccaaattcatactgaggttggtaatcatacaactggagctaaagtaaatggacggattgtaccccttgattatgagatcaaaaatggtgacattgttgatattttgacttcatcatcatcagctggtccaagtcgtgattggtttgatttggtttcaacacggcgggctcgtaataagattcgccaattcttccgtgcacacgatcgggaaaagaacattgaagaaggaaaacagcttcttgaaaatgaactccgtgaagcaggatactcgccagcagaattgatgactgatgaaaaatgtgaggaagttgctcaggagagtcattataatagtagtgatgacatgtttgcggctctaggatttggtgacttggctcccgtgggtattagaaatcgttttactgctgatatccggcaacaagttgaaagcgaccgccaacaagcagcagaaaaagctgtattagaagatcatcagactcttgaaaagccgaatgaacgtgaaaagcaaaaacaggctaaggcatcgagcgagggcgtaattgttgaaggagttgacaatcttcttgttcgtttaagtcattgctgtagtccaatccctggagatgctattactggctacattaccaagggacgaggagtgtcagttcaccgggatgattgcccgaatattaaagccgcccgtaagaatggcgaacgaattgttagtgtatattgggcaaatcctaatggcgacagaacaaactacaatgctgacttggaagttcagggatacaatcgaaatggcttattaaatgatgttttacgttcagtaaataacagtacgcgcttcttaaattcagttaacggaaaagttgaccacaataagatggtgacaattagtttgattatcggagtgcgtaatttacggcagttacaactgatcatggatggcttaaagaacattccagatgtttacgttgtcaaaagaattattcgataggaggatgcttgtgcgagttgttttacaaaaagtaaatcatgcagcagtttcaattgatgatgaagttgttggtaaaattggccttggctattttctcttagtcggttttgctccagatgataccgaagaaaagttaaactacttagtgcataaaattactaatcttcgtgtttttgaggatgaaaacggtaagatgaataaggggttgcgggacgttaatggtgcgattttatcagtctcccaatttaccctttatgctgatactaagcatgggaatcgtcctggtttttcacaggcggctagtcctgagattgctgaaccgttatatgatctttttaatcaaaaattagctgctactggtattcctgttgagaccggacattttggagcaatgatgaaaattgatttggaaaatgatggtccaacaacgattatttatgaacgctaaaaagtaaagagggagcgagacagaagtcacttgtgacttcgttttcgagcccccgcaagcaacaataggcctctaacgttcggtttgccggacattagaggccattgttgtactgcgtatttgctttttatgaaagtaacttaacttatgtcacagtttagtattgacttaaaatttgatcgactgcgccaccatagctttcgccaaataagattaaatgcatgcataggtaatagaagcgataccatgaaagacgttcatctagctgatcatcaaatggaaagacgctgctatatgcctggtaaaaactattatcaaaaccgccaaaaacagttgtcatggctaaatcaaattcacgatccccaaataatgcatctggatcgattaagtatggtttatgatcgccagcaaataagaagttgccggcccataaatcaccatgaagaagactagggataacttcatagtgttggtagtaatcagtaaatttattaaccatttgttggtaatgttcttgccgccatttattccatcgtccgcgttggcttgccacttttacttctgactctagtcgctgattaatataaaaatcaagccagcttgagttccaagaattgttttttacgagggccttggtttgatgattgtccataaagccgaattcatcattatgctgttggtgcattttggcaacggctaatcccaggtcagcttgattaccccaagtctcatcgagccagtttaaaattaaataggcattcccgtcaatttcaccatggtaaagtggggtcggggtattaatgaccttaccgatagctttgagaccattaatttcatgattaaaataatcttgtgaatggttaggttgaacctttataaagtacctatttccatcagtagttgtggcttgatatgctaaattaatatcaccaccactgactggtttaacagaagtgagattttttaatggaaggcgcttaaaccatgctgtgtttggactttccaattgatgttcctcctttattaaattactttatttataccatttttaggcaagtgttgttaaataaagttgatttataaggtaccaattaaccttagtattgacatttatgaggggatcgagtaaggtaaaaatgtaaattaaagatattaatagctgttgataaagaatgctcgggtacttgaaattatcagcgattggagaaaggtgagagctccaaatatttcagcctcgattgacccttttgaagctgggcaatatgctccgtcgtttagacgttatttttgagtgataccaaggtggtaccgtgcatttgcacccttgtaatttcaagggtgctttttatttaaactgttattaaaaactgaaagaggtaagcggagaatgaagagaacaaattatgctggggatacaaatgaacagcaagttggacaagaagttgtcttaaagggttgggtagctaagcgtcgtaacctaggtggacttatctttattgatttatgggatcgggaaggaatcgttcaactagtatttaacgaaaaagaaaatccagaagcatttgaaatcgcaaatgcggttcgtaaccaatatgttcttgaggttcaaggaaaagttcagttacgagcagaaaaagaaattaatccggatatgaagactggtaaagtcgaagtagctgttgatgaggttaaggtattagcaaagtcagaaacaacgccatttgatattactgatggtgttgatgcttctgaagacttacggatgaagtaccgttaccttgatttacggcgaccagaaatgatgcgtaatttgaagttgcggagtaaggttgcttcgatcgtgcacaattactatgataatgaagggtttatggatgttgaaactcctgatttaacacggtcaacaccagaaggagcacgtgactatattgttccatcacgtgtttatcccggtcatttctatgctttaccacaatccccacaattatttaagcaattgttaatggcagccggagttgataaatattatcaattggcacgttgtttccgggatgaagatcttcgtggtgaccgtcaaccagaatttacgcaaatcgatactgaaatgagttttgcaactcctgaagatatccaaacagttacagaaggtttaattaagcgggtaatgaaggaaatcgtgggagtagatgttaagaccccatttccacggatggaatggcaagaagccatggacaagtatggttccgataagcctgatactcgtttcgggatgttgattcatgacctttctgatattgtaaaggacagttcatttaaggtctttgctaatactgttgctgatggtaactatgttcgtgcaattcgcgttcctggtggagcagataagtattctcggaaagatatttctaagtatgaagaatacattaagcgttttggtgcaaagggccttgcatgggttaaagtaactgctgatggttacaatggtccagttgctaagttcttaaatgatcaagttgcccaaatcaatgaagaaatggatgccaaagaaggggacttaatcctctttgttgctggcagtttccacgttgtatcagattcacttggctaccttcgtcgggcaatcgctgaagagttagatatgattaagcctgaccaatggaactacttatgggttgtcaattggccaatgtttgaatatgatgaagggtttgggaagtggattgccgctcaccacccattcacaatgctaaatgaagaagacttacattaccttgaagatggggaagatcctcataaagctcatgctcaaagttacgacattatcttaaatggtaacgagatcggtggaggatcaattcgtatccacgatccaaagattcaagaaaaagttctcaaggctcttggctatacaaaggaacgtgcagaagcgcgcttcggattcttgcttaaggccttaacaatggggatgccacctgagggaggacttgcctttggtttagaccggtgggttatgttactagctcaagctgatagtattcgggatgttattccattccctaagaactcgaaggcagttgaaccattaacggcagctccaggtaaagttagtgaacaacaacttgatgatcttaaaattgaatttgatgaaaagattgattataagctcgatcaagatccagacgaacaataaatagaacaaaaataatcctcgtgaaaaggtacttgaagtgtactgttcacgaggattattttattaatgtctttagacctagttgagtgcgcgagcagagcgagtgcacgaaacaaaaaatcacctgctatgcgggtgggcgataaaaattatataaaaaaggcctcttttgccttaagatgtaggtgttcaagccaaagtcaataagggaaaagaggttatataaatatggctaataaattaaatagcttagcccatacgaagtggttatgtaagtatcacatcgtattcataccaaagtatagacgtaaagcgatcttcaatcaataccgaagagacctgagagattatattcgtttgttgtgcaaatataagggagtagaaataattgaaggtcatatgatgccagatcatgtgcacttgttagtaagtattccgccgaaactaagtgtctcgcagtttatgggatacttaaaagggaaaagtgcattaatgatgtttgatcgacatgcaaacttaaaatacaaatatgggaaccgacatttttgggctgaaggctactatgtgagtacagttggattaaatgaatccacgataaagaagtatatccgagatcaagagaaacatgatatagcaatggataagctaacaagtgtggaatattcggacccttttaagggtaagtgaggtagtataaacaccgcttaaagcggtggcaaagtagtcagagcattttggcttgagcaaagcgaaagccagcgccttgagacgccggcttttattatcggcttatagccgatgtgcaaaccacccgtttgacgggtggttatgatttcaaaatctttttcaaaaagtcttgtgcccgtgggctagtagggtgggcaaaaaattcttctggatctccagtttcctgaatatacccatctgccataaaccagatttggtctgctacttcacgagcaaaccccatctcatgggtaacaaccaccattgtcattcccgattcagctaaatcgcgcattacttttagtacctcatcaaccatttcgggatcaagggcactagttggttcgtcaaagagcattacttccggactcatctcaagggcccgggcaatggcaacccgttgtttttgccctcctgacagttgatccggatattgttgagctttatcgcttaaaccaactttttctagtagttccatcgcagttttagctgcttctttttcattgatatttttaactttaactggtgcaatggtgatatttttaaggactgtcatattaggaaaaagattgaaactttgaaaaaccattcccatcttttctcgcaactgatcgagttttttatcacttaagccaatcagattctgtccttcaaaaagaacttgtccgcttgttggttgttcgagtgcatttaagcaacggagaaaagtacttttacctgctcctgaagggccgatcacacaaattacttggcccttatcaacatgttcggaaatatcttttaagacaatattatttttgaattttttctgtaagtttttaatttcaatcattttagtgggcatgtttcattctcccttcaaagtaaaacaaaatcctggatagcgtaaatgtgaggataaagtagatgatcattgtgatgaatagaggtaaaactcctttataagttgctgattgcactaattgtgtttgatacatcaattcggaaacaccaatcacagaaactaatgaactatcttttaataaagtaataagctcatttcctaatgctggccaaatatttttaagtgcttgtggcataatcacatatctgaatgtttcgtttttactcatccccaagctccgagcagcttctgtttgtccaagcggaatggattggattccagaacgaataatttcagcaacataagcaccagagtttagtgaaacggcaataatcccagcgaggagggccggaagtgattgaataagtgccccaatcccaaagtaaacaaacatgatttgaaccatcattggcgtaccccggagaaattcaatgtagcaaaccgcaattgaatgtaaaaatttgttctttgaaagccgcattagtgcaaagagagtccctaataggaaaccaaaaataacagagacaactgtaatgattaatgtatatttaatccctttagcaaagtaacgccaatagctaagaacagtattttgctttttataactcttcatgtattgggaggcttcaggaatccattttttattaattagttgttctttgttaacttttttaattgtttggttggcagcattgactaacgaagtatcacctttaggaaaggccatggcaattccgccagcagtatttggcaatttcgaattaaaggcataaagatttgaattattggcagcataggctttagcagtagcagcatccattaaaatcccatcatatttatgagattgaagcccaatgactaaggaagaaagtttagcaagccctttgccgtttgctttaggcatttcctttgaaatcagggttgattggagcgtaccgttttgtgctcctacatttttcccattaaaacttttgacattaactagcttatctttatctcctttattaattaagaagtaactatcgccggaataatatgtatttgagaagtcaacgctcttttttcgttcagctgtaacgttcattcccgaaataatagcatcaattttacccgtttccagtgcaactagaagtgagtcaaagtccatgtttttaataactagttttactcccaagtctttagcaaattgtttagcaagggaaacttcaaaaccgacatatttagtttttccattttctttggttgtgaattcgtagggtggataatcagcactcattcccacaaccagtgttcctttttgtttaatcttttgtactgaatcattactagcgacttgcgatggattattggctgacgaagagctagttgaactgctctcgttagcagctaatgcagtaataggtgtacataatatcggaaacgcaattaccattagcagtaataaatgtttaaaacctttcatagctaataactcctttgagaatagtaaaattaaattgttactaaatatacacttaaatgtttatttatgcaatataaaatctgaaaaaagaataaatattcacatatttgcataacaattaaaagcgtttgcttagcttatggagtagtcaaagaataggtggataagaaatttaaatttttatttaaaagtaatgttgacagggtaggccatgttgggtaaaataatttttgtagtgaaaaggaagcagtatgcctgctacctcgatacgtaactttaagctcggagggagggatcaacatgtcaaaaacagtcgttcgtaagaatgaatctttagacgacgctcttcgacgctttaaacgttcagtttcacgtaacggaacattgcaagaatatcgtaaacgtgaattttacgaaaagccaagtgtaaaacgcaagttgaaatctgaagcggcacggaagcgtaagaacaagcgcggtcgtcgttactaaaatgtgtgctctcacctgttgcctggtgagagcttttttatatgaaagaaggataaataatgagcttactacaacaattaacgtcagatatggtatcagcaatgaagaatcgtgataaagaaacattagacgttgtccggatgcttaaagcagcggttcaaaatgaacaaattgaacttggccacgatttgagcgctaatgaagaaattgcggtaatggcacgtgaatataagcaacgtaaggaatcgcttgaagaatttgaaaaggctggacgagaagatctgatcaaccaagctaaaaatgaattggcaattgttgaaaagtatatgccaaaacagttatcaaaagatgaagttactaagattgttaaggaagtaattgacgaacttaatgcttctagtatgaagaactttggacaagtaatggggtcggttatgcccaaagttcaaggacaagcagatggaaaattagttaaccaggttgtaaaagaacaattgagtaagtaatattagctgtaaaaaaagagagtataaggagaaagtttcttcatactttctttttttactgtacatttttcctttttaaactagaattaaggtatattcaaaagaaaaggggcctttatatgtgcacatcagtaatttatacagcaggtgattattactttggtcgtaatcttgatttggaagtcaaccttggtcaagaagtagtgattaccccgcgtaataagactttagaattccgggaaatgcccaatcttgaacaccattatgcaattattggaatgtcaattgttcgtgatgattatccattatactttgatggggtaaatgaaaaaggggttgggatggcaggccttaattttgatggtccagctcattatttcccagtccaagaggggaaggataatattgcatcctttgaattagttccttatattcttgcggcagcttcctcggttgctgaagcgaagaagttactttcaaatgcaaacattgctaatattaatttttctgataaactccaagctgcaccgctacactggattattgctgataaaacgggtgcttctgtgactgttgaatccaccgcaaaaggattgaatgtttatgataacccagttggtgttttgacaaataatccggagtttcctcgtcaattattaaatcttagtaactatcgtagtgttgcacctgctaatccggctaacgtatttgcacctaatgtcgacctaccagtttatagccggggcttagggacccattttctcccgggaggaatggattctgaaagtcgttttgttaaggctactttcactaagatgcatgccccagttggtaattctgaggttgagaatattaccaactatttccacattcttcaatctgtcgaacaacaaaagggtttggatgaagtagcaccgaatacttttgaatatacgatttattctgatggttcgaacctaaagaaagggattttttactacaagacttacgaaaacagtcaaattaatgcagttgatatgcataaggaagatcttgaagcatcagaattaattacctatccagttcaaaataaacaaataattaaccaacaaaattaaataattattctatttttaaactctttttatgcatgaataatttatattttatgcataaaaagagtttttttgaaaaaatatgctaaaactattgatttttattcataatactcgtatatttataaacaacaaatttcaaatgagatggaggacgagattatgtcaaaagaaaaaattgttttagcttattctggtggtttagatacttcagttgcgattgcgtggctcaaaaataagggttatgacgtaattgcatgttgtattgatgtgggtgaaggaaaagaccttgaagcgattaaggaaaagggtctccaagttggtgcgtggaagtcagtagtgattgatgccaaacgtgactttgctgaacaatttgtattgccagcccttcaagcccatgcaatgtatgagcaaaagtacccattagtttcagcactttctcgtccattaatcgttcaaaaattagttgcagttgctaatcaatacggtgcgactgctattgcccatggatgtactggaaagggaaacgatcaggttcggtttgaagcaggtatccatgctttggcaccagagatgaagattgaagatccaattcgggattggcactggtcacgggaagaggaaattcaatacgctaaggataatggcattcctgttccaatcacaaaagctagtccatattccattgatgagaacttatggggccgggcaaatgaatgtggaattcttgaagatccgtgggctgcggcaccggctgatgcatatgatcggacagtttcaattgaagaagcccctgataccccaaccacaattgaaattacctttaatgaaggggttcctacagcaattgatggtgaagaaatgccgcttgaccagttaattatgaagcttgacaaattagctggtagtcatgggattggtcggattgatcacgttgaaaaccggcttgtcggtattaagtcacgggaaatttatgaatgcccagctgcaactgttttactagcagcccataaagatttggaagacctaacccaagaacgggaagtagcgcactttaaaccattaattgaacaaaagatgagtggaattatttataatgggctttggtattcaccattaatgaaatctttagtcgcttttattgatgaatcacaagcagttgttaatggagtagtaagggttaaattatttaaaggaaatgtaatctgtgaaggtcggaaatcaccaaattcactttatgataaaaacttggcaacttacacttccgctgatgaatttgaccaagaagctgccactggctttattaaactttgggaattaccagataaggtctatgctcaagtacaaaacaaaaataaaaagaaagtaaaggagaatacaagcgatgcctattaagagaatgtggggtggccggtttgaagaagctggcgaccaactagttaaccaatttaatgcgtcgatcagttttgatcaagaaatggctcaagaagacattgaaggctcattagcccatgtaaaaatgttgaaagaaacacaaattttgtcagcagaggatgctgataagattattgctggactcaagaaattacgtgagcgattaactagtgaaggactcccattttcgattgacaacgaagacattcatatgaatattgaggcattgctgacagaagaaattggccctgttgccggtaagcttcatactgggcggagcagaaatgatcaagttgcaactgaccttcatttatatgtaaagaagcgattgcccattatcattaatgaattgaaaaaattacaggcagaattagtagataaagcagcagaaaatgttgaaacgattatgccagggtatactcatatgcaacatgctcagccaatttcgtatgggcactatctcatggcttatttccaaatgtttcagcgagatgttgaacgttttgaatttaaccagcagcacacggatttatcacccctaggagcggctgctttagctggaaccactttcccaattgatcgacaattaagtgcaaagtatttaggttttgctggaccataccataattcactggacgctgtttctgatcgggattttgcccttgaatttttaagtaacgcaagtattttgatgatgcacctgtcacggctatgtgaagaactgatttattggtgtagttatgaatttggctatttagaattggcagattcatattctactggtagttcgattatgccgcaaaagaagaaccctgatatggcagaattgattcgtggtaaagttgggcgagtttatggtgatctttttagcttattaacgacaatgaagggccttccacttgcttataacaaggatatgcaagaagataaagagggattattcgacgcagtaaagacgattctcccaagcatcaagatcatgaccgggatgattgctacccttcaagtaaagaaagaagccatggagcatgcaactcatcatgacttttctaatgccactgaattagcagattatctcgctactaaaggaattccatttagggaagcgcatgagattgtcggtgagctagtattgaagggacttaagacagggacaaatcttgttgatattccattagacgaatataaaaagatttcgcccaaaattgaagaagatgtttatacctgcttacaacctaaagtagcggttgaacggcggaattcttatggtgggactggttttgatcaggttcgtcaacaaattaaagatgctaagaagattttagaaggtaaataattgtggaaattgagagtgagaaagcaaaaactttcctcactctcaattttttgtttcatagtaacccatatattgaattaaaggttacaattaaatataattgatgcaaaaataaaggatttacgagaatgattagggaaaagataagtttgtcaattcatgaaatgactgtcgttgccatgatggttgcaattattgctgttttaggagcagttccaggaattccgttggggtttattccggtgccaattattttacaaaatatgggaataatgattgccggagaattacttggaccaagattagggacaattgctgtatggctcttcttgtttttagttgtacttgggttgccactgctttccggtggccgcggcggaatggtaacaatattaggtccaactggcggatatatttttgcttggttatttgtcccattgttgattggccttagtctaaaattaagttggtattatgggatgacgcagggagtaactgaattcctgattgtttggctatggggtgtaatctttgtggaaggagtgggcgcaatatggttagctaatcaattgcataccacgcttattgctgctttgacttccaatattttatttgtttttggcgatacaatcaaagcacttattgtcgtctcaattactcgtcgtttacgtcacattaaggctttttcattaaggagatgattagcatggctcattcaactgcacagaaaattttatggcaattactttcagcgccagattcatggatttctggaaatgatttagcaaagcgattcaatattagtcgtgaatctgtttggaaagccatcaacggtttacgaaaaagtggaaataatattgagagccgtagaaaccttggataccgttttaccggaaattcacggttgagtgctgatattattgatttttatacccataaccactttactaatcgtctttacgttgaagatcaggttagctcaactcaaagcgtcgcaaaagcttttttgagtcatcacctagttagtgcgccaacagtatttatcgctgattatcaaattgctggttatgggagacagggacggtccttttactctccggcagcaactggactgtactttagtatgattttgcctagcccaacagacaaaccactacaagctgggttaatgacaacgacttttgcagttttaattggggaagttcttaaacaatttttccctgctcaagactttcggtacaaatgggtcaacgacatttatttaaatcataaaaaagtcggcggaattttgaccgaggcagtagtagaccttgaatcaaggacaacgacatccttggtggtaggaattggtttgaatataactacaaaagaatttccactggatcttaaagacaaagcgacgggaatagcaccagcagatcgtaatcttttagttagtcggcttattgagacgattgctaataattattcagactatgataatccccagtatcttgagcaatatcgccaaggctcaatgattttaggacagaaagtggacttgttagtaaatggtgaggcgattgctggaattgctaaaaaaattgaaaatgatggtgcactaacaattcgcttggcagacggaaaaacgaaaacttttaatagtggggaagtagttaaagttaattttgaaaaataacttcgattccttagaaaagcttgcagtgatgaggttaaaggtgatctatgatataattatcattaaataaaatctgctaaattaaaggagattgtataggtgggagaacaaaaaacaattgaacaaacttttcaaattgaaagtccagaaatagaagttggcttactaggaacacaggataagtttgtgagcctgattgaacaaggaatggatgttgaaatccgaccattcggtgaaaatcttaaagtaagtggacaagaagaagacgttaaacttacgatcgatgtatttcgtgcccttatttcgttgctaaaccaaggaatccgcatccacagtacagatattgttagtgcgatgaagatggcgcatcgtggaacactggaatattttgctgacctttacagtgaaacgattattaaagatcgccgaggaagagccattcgggtaaaaaattttggtcagcggcagtatgttaacgcgatgaagcataatgatattacgtttgggattggccctgccggaacagggaaaacttacctagcagtagcaatggccgttgcatccttaaagcgtggcgaagtagaacggattatcttgacgcgaccagcagttgaagctggtgaaagtctaggattcttacccggtgaccttcgtgaaaaagtagatccttatttacgaccaatttatgatgccttaaatgatatttttggagctgatcatacgcaacggttaattgatcggggaattatcgaaattgcgccccttgcttatatgcgtggacgaactcttgatggagcatttgtaattttagatgaagcccaaaatacgactaatgcccaaatgaagatgttccttacccgtttaggctttggttcaaaaatggttattaatggggatgtttcacaaatcgatcttcctcatgggactcgcagtggtcttgtaaacgcgcaacgaattctgaataatattaagtcaattaagtttgttaaatttagtgcagaagatgttgttcgtcacccggttgtagcgcggattattactgcttatgaggaccaaacatcaaaacaattagcagaaaaagataaagagaaaaaagaggaaaaatgatggacttggaaatttttgatcaaacaacagcgcagcttccaaatgaacaattggagatggtaagggacttattacagtatgctgctaaagaactttccttatcagaaaatactgaaatgtccttaacatttgtaaataatccagagataaaaaaattaaatgcccagtatcgtaatgttgatcgggcaactgatgttttaagttttgccgcagaagaggcgggagatgaaacaccaatcattatggatcctgaaatggctgctgaaattcctgttaacttaggtgacttatttatttccatcgataaggtagcagaacaggcaaagtttttgggccattcagttgatcgagagttaggatttttagctgttcatggcttccttcacttaaatggatatgatcatgaagagccggcagatgaagaaaaaatgtttaaattacaacgggagatactagacggttatggactcacgcgataaacatcaaactgagaaaaatcatcacttaattcaagcaatgtgtcacgcaatcgatggaattatccaagtgttacgtgaagagcgtaatatgcggtaccaccttttagcggcctgcttagccattattatgtcgatcttattgcatatttcagcaatggaatggttatggattttattggcaatctttgttgtttttacatctgaatttcttaatacggttaccgaagctgttacagatttgattgttgaccaccactatgaattaaatgtaaaaaaagctaaagatgtggccgctggtggggtactgatttcagcgatattttcagtcttggtggggctaattatttttatcccccgtatattagcaattattagataggaagttttaatatggataatccaaattataagtctggctttgtggcaattattgggcgcccaaatgttggaaaatcaactttattgaattatgttgtcggtcaaaaggtagcaattatgagtaatgttgcacagacaacgcgtaataagattcaaggaatttatacaagcccagaagcacagattatttttattgatacgccaggaattcataaaccatctactaaattaggtgatttcatggaaaaatcagcaatgtcagcattagatgaagtagatgctgtcttatttgttgtgagtgcaactgagaagcgcggccctggtgatgactttattattgaacgcttaaagaaagttaatcagccaatctttttagttgttaataagattgatcaaatcaatcccaatgatctgcctgaaattgttgaccagtataaagatacccttccatttaaggggattgtgccaatttcggctttgcagggaaataatgtgaataacttaatcaatgacattattaagatccttcctaatggtccgcaatattacccagctgatcaagtaagtgaccaccctgaacgctttgtaattgcagaaatgatccgtgaaaaggtctttttgctgacgagacaagaagtgccgcattcagtagctgttgatgtaacatcgataaagcgtgaggatgaaaatcatattcatatctcggccaatattattgttgaacgtccgggccaaaaaggaattattattggcaagggtggaaaaatgctgaaaaagattgggacaatggcacggcaagatattgaaagattacttggtgacaaggtatttcttcaactatgggtaaaggttgttcctgactggcgtgataagtctgcaatgctaaaagactatggctatcggaataaagactattaaaaggatgatggttacatggcacgcgtaaccacacaatttactgggatcattatgtaccgacaggattatcgtgaacgcgatctattagtgaaaatgcttactgataagattgggccggcaatgttttttgtgaaaaatgctaaaaaacgtggctttcggatgactgctgatatcctgccattcacccatggtacatacattggctcacttgatgaaaatggcttaagttttattaataccgctagcgatactagccaatacaagaagattgcaagtgacattagcaaaaatgcatatgttacgtatatcttggcattagttgacagtgcttttaatgatggccgaagcattggtggctggtttaagcaggttgctgcagcgttagacttaatcgaaaaaggattagatgagcaaataattacaaacgttattgaaacacagctgttagttgcttttggtgtagcaccagtttgggaccggtgtgtggtatgtggccgcaatgatctggctttagacttctctgaacaatatggggggatgctttgtcagaatcactggtcacttgatgaacaccgtctttatcttgaccgtaaaactgcttattatctccaacagtttgccacaattaacttgcaaaaattgaattctattcggattaatccagctactaaacgacgcctccaacaagtcttggatactctttatgataacgaggtcggactaaatttgaaggcaaaacggttcattaaacaaatgaataagtgggaacaaaatattggaaagttatcaatgaacgattgacatttgtaaaatatttttctattataagagcgtgtttaattgaatattggcaatgacagagattatggataaaccaaatcagcgagcaggggatagtgcaagccttgtaatttatttatccttggcactctaacagccgcttaaactaagctgttttacagagatgtaaaaaagtagggtggaaccgcgattaacttcgtccctacagtatcgattatttgatactgtagggactttttcattgaaaggagaagtaaagtatgacgaaaaaactaaccgtgcaagatattatctttacattggaacaatattgggcagatcaaggctgtatgttaatgcaggcttatgataacgaaaagggtgcgggaacaatgagtccttacactttcttgcgtgcaattggtcctgaaccatggaatgtggcttatgttgaaccttcacggcggcctgctgatggtcgttatggtgaaaacccaaaccggctttaccagcaccaccaattccaggtattaatgaagccttctcctgataatattcaagaattatacttaggaagtttgaaaaagctaggaattgatcctttagaacacgatatccggtttgttgaagataactgggaaaacccttcaatgggctgtgccggtgttggttgggaagtttggcttgacggaatggaagttactcaatttacttacttccaagtcgttggagagttgccaatgagcccagtggccgccgaagttacttatggacttgaacggttggctgaatatattcaaaacgttgattcagtttatgacttagagtgggcagatggtgttctgtatggtgatatcttccaagaacccgaatatgaacattctaagtatgcgtttgaagaaagtaaccaagacatgcttcttcaagactttaatgattacgaaaaagaagctaaacgtttaattaagcttggattagttcacccagcttatgattatgttttaaagtgtagtcatacctttaacttgctagatgcgcgtggtgctgtttcggttaccgaacgtgctggttaccttcaccgtattcgaattatggcaaaatcaattgctaaagcatttgttgaagagcggcgtaaacgtggcttcccattgattcatgacgaagcagttcgccaaaagacagttgaagaatatacaaaaaaagcggaaaaggcaaaggaacgggccacaaagcaagcagctaagaaggcacaaaagggggaaaagtaagatggcaaatacatacttattagaagtcggtgttgaagaaatgcctgctcacgttgtaacaccaagtattaaacagttacacgaacgagtagcaaagtaccttaaagaacaacggattacttttgatgatattcaagaattcgctactccacgacggatggcgttactaatccatggtttaagtgataagcaacctgatattgatgaatcagttaagggtcctgcaaaaaagattgcgcaagatgctgatggtaattggaccaaagctgcaattggttttacccggggacaaggtgcctctgttgaagatattgaattcaaagaagtaaaaggcgttgaatatgtttttgttgaaaagcatattgctggaaaaactgttgctgaagttcttcaaggattgccagcagttattacttcgatgacattcccaaccttgatgaagtggggctacaataacttacaatttattcgtccaattcggtggctagtttcattattaaatgatgaagtcgttccatttaatattttggacgttgaagctggtcgagaaacacaaggtcaccggttcttaggtcatccagttgaaattgctaaggctgatgattatgaagaaaccttaaataatgatttcgttattgctgatcaaacaaagcgaaagaacttaattaaggatcaaattactaaaattatcaatgaaaacaactggcaagttgattgggatgaggacttactagaggaagttaataacttagttgaatggccaactgcttttgctggatcttttgacgagaagtacttagcattacctgatccggtcttaattacttccatgaaggataaccaacgtttcttctgtgtacgggatggagatggtaacctcttatcgcactttatttctgttcgtaacggtaacaccgactaccttgataatgttatcaaaggaaatgaacgggttcttgttcctcggcttgaagatgctcaattcttctatcaagaagaccaaaagctgacaattgatgaatatgtggaacgacttaagaaagttagcttccatgataagattagttcaatgtatgacaaaatgcagcgggtcgcagtgattgcgaatgttctcggtaagcaactaaatctttcagatgaagaactagcagaccttgatcgagcagcacatatttataaatttgaccttactacgcaaatggtgggtgaattcgctgagttgcaaggaattatgggtgaaatttatgctaagctattcggtgaaaaagatgatgttgccacagctattcgtgaacactacatgccaatctctgcagaaggggaattgccacaaactaagattggcgcggtcttagcaattgccgataaacttgacagtatcatgagtttctttgcagttgatatgattccaagcggttcaaatgacccttatgctttacgtcggcaggcatttggaattgtccggatcatcgccgatcgtggttggcaccttccattattaagtattcaatcagaaattgcccctgcctttgaaaacgctgaaatcaatgtttcctttgatttgaataaaaatagtgatgaagtccgttcgttcttcttggaccggattaagcaattattccatggtcaaaaggttcgtcacgatatcattgatgcagctaccgatactcgtcaaaatgatattgctaatatccttgaagctattcaaactatcgacgatcataaggatgatgataactttaaagaagatattgaagctcttacccgggtattacggattgcaaagaaggataaacgtccagttagtgagcttgtagtagatcctaatttatttgagaacccatctgaggctaagatgcatactgctgtttcagaattgattaaggaaaatcaacagacagtaagtgaaaactttgcagcattacggactttaacaccaataattagtgaatattttgatgaaaatatgattatggataagaatgaagacattcgtaataatcgtttggcccaattaagtattttggctcaccaagcatcattaattggtaacttggataacttgattgtaaaataagacgttttaattgtattgctgctaacttgtggtattatagatactagttaaatgtaaaaataggtggaggtcgcattccgttaggttgcgacctttcatttcgttgctgttcgcttactaagtgaggtggatcaatggcaaagataccgcgtaatgtaattgatgaaatacgaaattcagttgatattggtgatgtaattgggcgctatgtccaactgcatcaggctggaaaaaatctaattgggttatgtccctttcatgatgaaaagaccccctctttttcagtgaatgaggaaaaacaatttttctattgttttggatgtcaccggagcggaaatgtatttcaatttttgatggagttaaagcatatcgattttgtcgatgcagttaaggagatcgctaacgatagtaatatcaagattcctgaacaatatgttagcgttccggctaaaccatcaaataacgagaatcgacagctgtttgatcttcatgataaagcagctaaactttatcaccatatattggtaaatacaccggctgggcaagttgcacttaattatttaaaaaaacggggaatgagtgaagaactgattgagcaatttggcttaggctatgctcctgatcagcgaatcttaaagccgttcttccagcagcaaaaagttgattaccaattgctaagaaaaagtgggctttttagtgaagaccaacagggagagttgcgagaccggttcattgaacggataatgtatccgataaaaaatggtcaagggcaggtaattgctttttctggtcgattaatcgataccagtaaaacaaatttacctaaatatttaaatagtcctgagacaccaattttcaacaaacgacggacattatttaattttgacgttgcacgaaaagcagcccgtaaagatggtcgattatacttatttgaaggatttatggatgtgatctcggcctttgccgcaggaatcgaaaatggaattgcttcaatggggaccagttttaccgaagagcaagtagcgattattggtcgtgctacaaagcaattagatatttgctatgatggagatcaaccgggacaaaatgcaattgatcgtgcaattagcctcgttaatgatcatcgacctaatcagctccaggtgaaggttgtccaattaccagctgggattgatccagatgaatatgttcaaaagtatggtccacagcaatttaacgcctatcttactaataaggaagaaacaacaacagaattttacctgcgctttttaagaaatgggaagaatttagataatcagaatgagctgatgcaatatcttaatcaagcactgaaggtaattgctcaagttcaagctcccttagaagaagatatgtacttgcaacggttagcaagtgagttcaatttagatcggcaaaccttaaagacgcagttagatcaattgcgacagcaactaggaattcataatcagccatggactaagcaacagccttcactagtgcgtcatcaacagtttcaacaaactagtgaagaagaacatcgaaaagttaaacttagtaggactgaattagcggaacagatcttactaaggtatatgctatatgatcgtgaagtgtggatgcatgtaacatcagaccacgattttcattttgcgcatgaaaaatatcaaaccttgtatttattagcagcaagttatttttctgaaaacggctcgtattcaactgctgactttcttgattatttagatgaaagtagtttacaaggtactcttgggcaaattgaaaatttaaatgttgaccaagaagttgatatgcgggcaattgatgattgtatccatatgatcgcagaacaaacaccgttagctgcgcaaattgcagataagcaagcccagttaaaagaagctaattcactgcataatacagaattagctacgcaattaacgattgaactggtaaaattattaaagcagcagcaacgcttaaaaacggaggagactaattaatatggcaaagagcaagaaaaaagacattgttatttctaacagcgccgatttcgatcaacaagaatatgacaccgcagttggtaagttaattcgtaattacaagaagcaaaagcagattgaatacgatgaattaactactaaaattgctaaaccatttgaattgaacgctgacggaattgacaatttacttcaaaatattgaagatgccggaattagtgttgtcgatgaaaatggggatccagatcctcgtgctttaaaagctactgaaaaattctcacaatctgctatgaaggatacatcagctccaactggagttaaaattaatgatcctgtgcggatgtatttgaaggaaattggtcgtgtaaatcttttgacggctgatgaagaagttcagcttgctttacggattgaaaaaggtgatgaagtagctaaacaagaattagctgaggctaacttacggttagttgtttcaattgcaaagcgttatgttggccgtgggatgcagtttcttgacttaatccaggaaggtaacatgggacttatgaaggccgttgaaaaattcgattatcggcggggatttaagttctctacttatgctacctggtggattcgtcaggctattacacgggcaattgctgatcaagcccggacaattcggattccggttcatatggttgaaactattaacaaattgatccggattcaacggcaattacttcaagatttaggtcgtgaaccgttaccagaagaaattggtgcagaaatggatatgccaactgagaaagtgcggaatattcttaaaattgcccaagaaccagtttcacttgaaacgcctattggtgaagaggacgattctcatttaggagactttattgaagatcaagatgcaacgagtccagctgaccatgctgcttatgaaatgatgaagaagcaacttgaaaatgttttggatacgttaaccgatcgtgaagagaacgttcttcggcttcgttttggcttagatgatggtcgaacacggacccttgaagaagttggaaaagtcttcggggtaacgcgggaacggattcgtcagattgaagctaaggcgctccgaaaattacgtcacccatcacgttctaagcaattaaaagatttcttagaataaaaatatatatgtaaaaagatgaatttacacaaaaagcaacttgagttaattaattatcttaagctgctttttaattttatttaaaataaatgagagaaatcttatttttatattgaaaacattcaattgttcgggtaaaatttttataaagcgttttttaaatctattataaataaaaattgaggagagatcgaacaatgccagaactatctgctgatttatatggaactgttagtcataagttagatgcgttacagccatcaggtatccgtgaattcaacaaagaagtttcaaagattccgggaattattaaattaacattaggagaaccagacatggcaactcctgaacatgttaagcaagcagccattagaagtattgaggaagatgattctcactatgctccacaaatgggaaagccggaattacttgaagcaatcagtgattatattcagaatactcgtgatgtgcactatgacccacaaacagaaataattgcgactgtaggagcaaccgaagccctcgatgcaactttatttgcaattcttaatactggagacaaagttgtggttccgaccccgattttctctctatatttcccattaattgaaatgacaggagcaacagttgttcaggttgatacttcagcagataattttgttttgactccagaaaagcttgaagaagttcttgaagaagaggggaaaggcgtcaaagctgttatccttaactacccaagtaacccaactggtcgtgaatatcctcaggaagttctagcaggattagctgaagtaattaagaagcatcatttatatgcgattgctgatgaaatctatagcgaactagtctatggggtagagcactattcaattgctactatgattccagagcggacaatttttatctctggactttcaaaatctcacgcaatgactggttaccgtttaggatatgttgcagctccggctaagatcatgactaatatttcaaagatgcatgccttcttagtcacaaccgtaactaataacgttcaagttgcagcggctgaagcactgacaaatggtttaaatgatccattagaatttcgaaagatttaccagcatcgccgtgatttactcgttgccggtcttaagaaattaggctttgaaatgttaactcctgaaggggccttttacctgtttgctaagattccagctcaatttggaactgacgatgttgcctttgcaaagcagcttgctaaagaagcaaaagttggagtaacaccaggtagtgcatttggtaagggtggcgatggttatgttcgtctgtcatatgcctcctctgatgaaaacctaacagaagccattaaacgaattagtgaatttttagaccatcttgcgtaaattataaggaagtaggaataggactccgtatctgtcaagttttcataggtagcctttaaatatacagttttagtgggttagtgccttaaaaagttgtcctattggtctacttgtggccgtattaatcggaattattccttgtactactccaattgacggctttgtcggtgcctttcttagaaactctccagttcgaatatgcatttcctgtaataggctggtttgagccactcgaggaagaactgttaattgttctaggattgtatttaaactagcttgcagttcaccattcattcgggcttcaattaaaccaatcatggctttagccccctgcttagtccatgacttgccctgtttcttcatccggtaagtaaaagcccggtgagaactttcgactgaaccaattaaatgaatatccttaaatccacgcatttgtggtgagaggatataccgccaatttcgctgtagatactttcttaaacgcattaggtcgtctgcttgtttttccgttaggttttgtgattcataagtatctaaaattattgttagctctgcttgatcatgatgacgaacggctttaattgctcgcatggctaattcgttgtgccggcctaaagtatgttcaattttctgtaaacaatgatagcggtcgagaaagtattcaccatgtgcaccttgaggaactagacttaatagcttagctggttcgtaacctgggccagcgtcactggccaaaaagatcgtttgaccggcaagcttataatggcggtctaaataatcacttagtcgtgcttcaagccgtccttggtgcccaacactgagaaagtcatgccgattaatgatttgattagctactcgctcataaacccgataatggtgcacaagagtcagctgacctgcttcttttttacctttaatcataaaggcatcaccctcaatagttaaatttttaggcatatggcgaggagtagcttggtgttcttttgcttgagtttgtttagctacctgatttcctaactcatgcacggcgtgcattaccgaatcggcagtaattccgctgtcaaatacaaggttcaaaatgtcggcagtattgcgcattgtagttgtttgggcaatcttagccatcatcattaagtagtgtggcgataaacgacgacgtggtttaatttttaattgttggtctaagtaaaattcacgtttctttgtcccagcctgataataccgtcgttgaaaagtcaccgggccaaagataaaattaagcgtccgtggctgtttattgattacttgatagttcgctggagcttgggactttaagcttcgatctaagctttccaaaaagttttgcatgattacttgtcctaactccaataccccttttaaaataatctgttcagcttcaaataaactgcctgatttcaccaaattctgctcgatttctgttaaaatatccatgaggaaagacctgcctttgcttagtattcgacacactaaaggctactggtcttttctttttttgtaaataagtaaattggtctacaaaaaagatttccacgaccagatgaattattcatccaacctatgaaaatcttacactaactaggactcctaagtgggtgctatcttgcttcctctttttgttataattaatttattaaatagaaaaaggaatgatttttgtggatgaaaagcacttatcagcacgtttagcatgtgttgcttcccttgttccagcaggtgcgcgggtggctgatattggttctgaccatgcatatttaccagccgcattagtgttagatggtaaaattgattttgcaattgctggagaagtagtaaagggtccttatgaaaatgctgttcatgaaataaaagaccaccaattagaaggcaaggttatcccacggttggcagacggtttagcagcgattgaaccagcagataaagtcgatacaattacgattgccggaatgggcgggagtttgattgcttctattttagagaagggcaaggataagttaacggaaattaagcgacttgtcctgcagccgaatgtaggggaaagtcaattgcgtgaatggttaatgaataatcattaccaaataatgaccgaaaaaataattgaagaagacaatcatatttatgaaattatcgttgcggagccatcagttgtcccatttagatacagtaagtatgagcttgattttggaccatttttattggaaaacaaagggcctgtttttaggaaaaaatggcaagaatatcttcaacgtgaagcccatgttattgatcagatgcaaagggctcaacagccaccagtaaaaaagattaatgagataaacgagtttttatcacaagtaaaggaagcgatcgccgatgacaaccggtaaccaattaattgcgcgttttgaaaaatttgctaatccgcaactagcagaaaaatgggaccatgttggcctgcaaattggcaatccagatctcccaatcactcgcctaataaccacccttgatgttcgcccagaagtggttgatgaagcaattgagcaaaatgttgactttatttttgctcatcatcccatcatgtttcatccagcaaaagatctagatacgcgggatccgcaaaatgcaatgtacgctaaacttttggcgaataatattactgtttatgcagctcatacgaatttggatactgctaatggcggaatgaatgactggttagcagatcaacttcacctaactaatactgtgcctttagtgcccgcaggaaatgatccaataagcggtgaaccagttgggatggggcgtgttggtgagctggctgaaccattaacactgcaaaaatttgcaaaatattgtatggatgtttttggtatccgcggattacggttaattgtcaacccgcttgaccaagagagagagattaaacgtgttgcagtacttggtggtgctggtcaagacttttatcaacaagctcttgaagctggagcagacgcttatgtcaccggggatgtaagttaccactttgcgcacgatatgattgctaatcaccttgttgttattgatcctggacatcatattgaagtggtagctgcccaccagcttgctaacttaatcacccagtggaagaatgaaaataattggcagtttgaggtgctagagagtagagttaatacagagccgtttacttttattactaaataggttttagataaggagatgctaatcatgagtgaggaaaagtatgaggggttattaccacgttttttgaagtatgttaaaactgaaacaaggtcaaatccagattcaaaaacaattccttctgatcctaaagaaactgcatttttaaatgaattaaaagctgaattgatatctttagggttgagtgatgttcatattaatccacaaagttcatatttggtagccacaattccaagtaatattgacaaggatgtaccaacggttggcttcattgcccatatcgatactgcagattttaatgctcataatgttaatccacagattgtcgaagattacgatggcaagtcagatattaagcttgataaagatggccaatatgtcttaactactactgaatttccatcattgaaaaaatatcagggcaatactttaattactactgacgggtctactttgcttggggctgatgacaagtcaggagtagcggagattgttacaatggctgcttacctgatggctcatcctgaaattaagcacggaacaattaagattggcttaggacctgatgaggaaatcggtaccggggctgatcattttgatgttaaagattttggggccgattttgcctatacggttgatggtggcccacttggcgaattggaatatgaaacatttaatgcagctcaggcagaaattgagattcaaggaaaagatgttcacactggggttgctaagggaacaatgatcaatgctattcaggttgcaattgacttgcaaaatagtttgccggcacatgatcgcgcagaacggacagatggacggcaaggattctatcacttatacaagtttgatggaactgttgatcatgcttcaatgacttatttaattcgtgatcatgataagcaaacgtttattgaacgaaaacatttactcgaacgggttgttgctggcttaaatgatgaacttggtgcagacctagtaacgatgaatctttatgaccaatactacaacttaaaagatgcgcttaaagatcacatggaagttgttgaaattgcgaagaaagctatggaaaatcttgatattaaacctgatatctatccagttcgtggcgggacggatggttcaacaatttcttataagggcttaccaactcctaatctttttgctggtggagaaaatatgcattcgcgttttgaatatgtatcactgcaaacaatggaacgcgcattggataccctgcttgagattgtgcggttgactacggaagaagataaataaattaaaaaggatcgagccattttggactcaatcctttttaattaatcttcatttttgctaggatttgcatctgcggtaattttatccacacaattgataacaattaatcccataattacagaacaccagccgacaagggtgtagtctggtgtcatcgattctagttgacttgtgatgtaagctaggacctcacccagaataagtgcccaaataccagccacgatattctttgataaaaagttcatgttggtcatcccctttgaagtcataccatattctagcatatttattaatgcttttgaaagggttgggttaatttctctatttagtctgatttgatataattttattgagaggtgaaatgaagtggattttacgcccttagatgttaagagtagttatagtttgctaaaaagtccaacccggatttctgacctagttacaacggctaaggaacgagggtataaggcattagcgttaacagacgaaaatgttttatatggggctgtcgaattttataatgcagctaaaaaagcaggaattaaacccattctcggcttgcggctggtagttgcattaaatgagacagatggtaccaagctagatttagtatttctagctaagaatcaacgagggtaccagcatctgatggacttatcgacgcttcagcaaacacgaaaagataaaaaaatatctttaacgattgcacaaattagtcctttattgggtgaattgtttataattattcctcctcaaagtacggtttttagtgtacttgctcagccaacatcaattttaactgagcttgctaatctgggggatgatgatagcgtcctgttaggagtcaattcgcggttagatgacgttcaaatagataccttgcagcaattatcaaaacaattatctttaccattagtagggacgtctccagttgattatttaaatgctaatgatctttttgctagtcgggttttacaagcgattgatgccggagttgagttaaaagatccgacaatagaagcgggacgaagaggacaacattatcttcattcgaaagaacagattgtccaagattacaatgcaaaggggcttagtgcagccgcgcaaaagacagttgaagtagcagccctgtgcaacgttgaacttcaatttagggccccggtccttcctcattttaaaaatcaagcagggataccatcgcaacaatatttacgttccctatgtattcaaggattgaaaaaaagacgagtagcaccaggaaaaactattcaacagtaccaagaacgtttagcgatggaattaaaagtaatccatgaaatgggctttgatgattatttcttaattgtatgggacgtaatgaattttgctcaccagcaaaagattacgaccgaccctggacgaggatcagctgcgggatcgttagttgcctatgctttagcaattacagaagttgatcctttgcaatacgacttattatttgaacgctttctgaacccagaacgagctcaaatgcccgatattgacttagatattcctgataatcggcgtgatgaagttttgcagtatgtacatcaaaaatatggtcaccaacgcgtagcccaaattattacttttggaacgttggctgctaaacaggtcgttcgtgatgtgagtcgggtctttaacttaccccgttacgatatgcaaaggttaatcgatgcattaccgcatggccttcacgtgacactcaaagatgcattaaaggagtcacaacaattaaaaaatcttcttgatgataatcctaaatttcgtttgctgattcaagttgcacagcaattagagggattgccgcgtcattattcaattcacgcggcaggtattgtcctttctgagcagccattacatgaaattgtgccgttacaagatggtagtgatggcttattaatgacgcagtttgccaaagacacagtagaagcgctggggctattaaaaatggattttttgggattgaagaacctttcaatcatggataacacccttcaaatgattcggcaagaagaccctacttttgatttgcaaaaaattaactttaatgatcagttgactcttcaactgttccagcgaggaaaaactgaagggatttttcaatttgaatcaagtgggatcagaaatgtattggtcaatcttcatccaacgaattttgaagatattgtggcagtgaatgcactttatcgtccgggcccaatggaaaatattcctcactttaccgcccgcaaagctggaaaagagaaaattacttatcctgctccttcacttgaaaaaattctgggaccaacttacggtattttggtctatcaagagcaggtaatgcaactggcctcggtaatggctggctttaccttgggagaggcggatcttttacgccgggcaatgagtaagaagaaaaaggccacaatggaggatatgcggacaaaatttattgctggcgcaacagaacacggatattcagcacaagttgctcaccaggtatttgaatatatcgatcgctttgctaattacgggttcaatcgttcgcatgcagttgcctattctatgatggcgtttgagatggcatatttgaaagttcattaccctgcagctttttttacagccctaatgaatgcagaaactaatattgagaaattgaaacgtcacgtgggggatgcaaagcaatttggcgttaagattagtagtccgcgaatcaatataagtgagagtagctttctgttgcatgatgagacagtttactttggcttctctgctattaaaggagtacgtcgtgattttatcgccgcaattctggaagaacggcaggaaaatggtaagtttacagatcttcgtaattttattgcgcgtattccagaacgttggcaaaaacaagaattaatcgaaccgttaatctatagtggggcctttgataagatgggatataaccgagcggagatgattgacgcccttcctaaattaatttccgggattgagttgtttgctggttttgctaattttgacgatccagctctccaaacggcaattgaccaacgaaatgaattccctctgttgacccgtttaacgaaggagaatgaatacttaggagtatatctttccggccacccggttactcaatattaccaattaggacagcagctccatgcaactaaaattgctgatttatacccgaattcagaagcgacaataattgtccttacaaatcatgttaagactatttatactaaacgtgaacatcgagaaatggcctttgttaatggaacagatgagaccggagcaattgatattactgtctttcctaaacaatatcagcagttcaaagagcaactagaaacaaataagattttaattgtcagaggtcgagtagaatatcgtgagggacggggtctacaattagttgctaatcaattgcaggatgttaaaaaaggtcaacagaaacgccgcaagcaacgatgggttttacgaatcttaccgtcattggacactgagatggtgcatcgagagttaaataatatttttaatgaataccatggttcaattcctgtcttgttgttttatccagcaaccgataagaagatcctgcttgaccaaaaacgatggttagaaaattctcagaaagcaaaaaaggcgcttggcgccgttcttggccaagaaaacgttgtcttacaacagcttaatagtaatcactgaaagctataaaattaaataacagttagaaaaaataactaattttagaatgatagcgcttttttaaaaccttttgcataaaaaataaagacacgttatttgaaaagtgctatcataacagtgtgcaaatgaggcatacaattacagattgtgattgatgctatagatgcaaaaggagagattcatttatgaagaaaaccaagattgtaagtacacttggtcctgcaagtactgatgttgatacgatcgttaagttgatcaatgcgggagctaacattttccgtttcaacttctcacacggtgaccacccagaacacttgggtcggatcgaaaacgtacacaaggctgaagaaattactggcaagcacgttggtcttatgcttgatactaagggtgccgaaattcggactactgttcaaaaagaaggtaagatcaactttgaaattggcgacaaggttcgcatttcaatggatccttcaattgaaggtactcatgacaagattgctgttacctacccaggcttatacgatgatactcatgttggtggccatgttctttttgatgatggtttaattgacatggttattgatgaaaaagacgatgcaaacaaggaacttgtatgtcacgtcttaaaccatggtgttcttggttctcggaagggtgttaacgcccctggtgtatcaatcaacttaccaggtattactgaaaaggacagtagcgatattcggtttggtttggaaaacaagatcaactacattgctgcatctttcgttcgtaaggctcaagatgttcttgacattcgcgaattacttaaggaaaagaacatggaagatgttcaaattttccctaagattgaatctcaagaaggtatcgacaactttgaagaaatcattgctgtttctgacggtttaatggtacctcgtggtgacatgggtgttgaaattcctgcccaaaatgtgccaattgttcaaaagcacatgatcaagcgttgtaacgaattaggtaagccagttattactgctacccaaatgcttgactcaatgcaagaaaacccacgtccaacccgtgccgaagtatcagacgttgctaacgccgtatttgacggtactgatgctactatgctttctggtgaaagtgctaacggtgactacccagttgaatctgttgcaatgatgaacgacattgacatcaaggctgaaaaccacctttgggaattcggtactgaaaagttcgattgggacaagtctgacgtaactgaaactatcggttctgctgttgctaacgcagctaaagacttagacattcacacaattgttgcttacactgcttcaggctacactgctaagatgatttctaagtaccgtcctaatgctgatatcgttgcattaactccaaacgaacgtgtagaacgtggacttatgatcaactggggtgttcaaccatacgttgttgatgaaatgaagaacactgatacaatgttcgacttagctgctaagaaggctgttgaacttggctttgctaagaagggcgacaagatcatcatcgttgctggtgttcctttgggtgtaccaggtgcaactaacatgatgcgtgttaagactatcgactaatattttataatattgtctgcaaaaagatcggtcattggtaaccggtctttttttataccaatgataatcattgatcttactagcaaaataagcctttaccgtgtaaaatcgatatagaataaaaaaggataagtgataaaaatgaattcagcattaggaaaagttgttacagcggtaatgattgatgaaaatgataccgattattttgttcaaccagatcgtaatgggcaaacgtatcgattaccgaaaagcgaaagttctcaagaattacatattggtggacaggtacgcggttttgtttatgaaaatgaggaccaccaactacagatgacctgtaagcacattccaacgatccaggttgaccattacgattatggtacagtagttaatgttcgtcgtgatttaggggtttttgttgatatcggtcttcccaataaggatattgtcgtctctttagatgatttaccaagcttgaaacacttatggccacaaccaggtgaccgtttattaatgtcccttcaagttgatgataaggaccgtctatggggtaaattagcagatgaccaaatctatcaaactatttcagcagctccagataaacgcctgctcaaccatgatacttatgccacagtttaccgccttaagatgagtggaacctttgttattactgatgattatcgtttaggattcatccatcccagtgaacgagaccaagaaccacgattaggtcaacgggttaaagcgcgggttattggaatttcgtcacatggtagtctcaatctctcccttaagcctcgtgcctaccaagctattggtgaagatgcacaaatgattttgacaatgttagaacatgatataaatcaccgcttgccatacactgataagacggacccatcgattattcgcgatgtctttggcataagcaaggggcagtttaaacgtgctattggacatttacttaaagaaaaattagtaaaacaagaaaatggccaattaatcctagtaaaagagaatcaagattaatgaataacgaagtggctgcgtttttagcttttttaaaagatgaacgacaattaagcgataataccttgatgagttatcaacgtgacttagaacaaactgtgacttatttagaagatcgagggattgtcgattggcaacaggtggaccactatttactaattgaccttcttaatagtcttcgtcagcaggggaaagctaattcaacaattaaccgtgtgatttcaagtttacggcaattttataaatacatgatccgtcaccataacctaaccattaatccaatggaaatgattgatcaccagtatacctttaaccaaccacctgcaccggtaattttaactgaaaaagaaattgaacaactgctggcagtcccggatgtttcaaccccaattggccttcgtgatcgagcgttgttagagattatggatgcaacgggaatgagggttagtgaagtaattgctttggatctgacagcacttcatctcgacgttaagcttctacaactaacgggaaagaatgaacgtgaacgaatgattcccttaagtcaaccagcagttaagtggcttaccgactacctagaccgcggtcgaccacgtttactcagagatgagcacgaaacgcgggtgttcttaaatgctcatggttatcctttgacgcggcaaggaatttggaaaaaaatgaaggaatgggttagtgaggctaaaattaaaaaagaagttactcctcaaaccatgcgctattcttttgctgttcatttaatagaaaatggcgccgacgtccaattaatccaagaaatccttggttataacgcgatgaaggctctccaaccatatttacaggtttcgccgcaacagttatctgctaactatatgaaatatcatccgcgtgcatagaaaggaaaatacgatgttagttcgttatcgaaaagattaccaaaaaatcgccctaggtttattgtccttagtaaaagaccttcgaaaagataatcgctttatggaggagatggactgggcacttgctaatgattggccaatctttttgtggaaagacatggatgatagccactttattggaattgtgattttagaaataggagattgttacgtactgattcgccgcttatcatttacgccaagcgaacgaacggggcataatattttttccttattagatggcgttcacgatcagtatcctcataaacgcctcatgggaaccttagcaacccaaccaataattagcatgtgggagagaaataatgaataagcaagtgcaaccacaaaatctatttcaaccagtcataaaagttcatgactttgaagggtcactagatttattacttcatttaataaagcaatctgaaatggatatttatgatattcagatttcgcaaattacaagccaataccttgattaccttcaccaaatgcaaagccaccaattagaagtcgcgggtgaatattttgtaatggctgcgactctgatggacattaaaagtcagatgctgttaccttcgccgccagtattggatgatgagccagaagtagaggagattgatccccggcaagaattagtggaacagcttttggaatatcagcgttataaaaaagcggcagatcgattaaaagataaagaaaatctgcgtcaacaggagtatactcggccagcaatgcaggttcctcgtgaaatggtaaaatctcatgtggagccgggcatcaaattaacggatttgcaacaagcttttgcagcagttctccgccgccaacaattagctactccattagttgaaactgttgcagctgaaaaagtaagcattgggcaacaaatgaaccacgtgattgaaattgttcatgatggtccggttagatttgaagacttgtttaaagatttacatactcgtgatggcttagttacaacttttttagcaattcttgaactagcaaaacatcaagcaattactattaaccaaggtggcttgtttgaaccaataattttagtggagggacctaagagtgacgaatacgaaactaaccaaccaagcgcagattgaagggttactttttattagtggggatgaaggaattaccctaggcgatttagcaaaaatttctggttttatgaaaccggctgttctagcaatattacaagagctaaaaaagaagtatgaagatgatcccacgtctgcttttatcttacttgaaagtgatcagacctatcgtttagcaaccaagccccagttagcagaggtcattaaacattactttgaagttccattaacggtgccattaactaaagcattactagaagtattggccattgttgcttatcggcaaccaattacgcggctagaaattgatgatattcggggagtgcaaagttcaggatcattacaaaaattaatggttcgtggattagttgacacccatgaacgcttggatgcacctggccggccatttttatattcaacaactccggctttcttaaactatttcgggttaagcgatttggatgaacttccaccgctacctgatcaagatgaattagaaatgagtaattttaatggtgatattttcctcgaagcgttacaagcgcgagaagaacgaaaggacgataattaatggaacgattacaaaaggcaatggcggaagcaggagtagcttctcgtcgggcatcagaaaaacttatccttcaagggaaagttgcagttaatggcaagattgtgactgaacttgggactaaagttggtgttcatgatgagattgtagtaaatggggttccaatccatcatgaacaacacgtttactacttgctaaataaaccgcggggtgttatctcaagtgctcatgatgataaggggcggcgaacagtcgttgacattattcatgatgctgatattgatgaacgcatttatccagttggtcgattagactatgacacaaccgggattcttctcctaacaaatgatggtactttggcaaataaactgatgcatcctaaatatgaagttgaaaaaacttatgttgctaaggttgaaggaatcgtcaaaaatgatgagttaaaacaattacgtttaggggtgatcatcgatggccgaaagacaaaaccggctaaatcgaagctcctgaatgttgaccgtgccaagaagacaagtcttgttcaattaacaatccatgaaggacgaaaccaccaagttaagaatatgtttaaggcagtaggacatccggtgactaaacttcatcgtgaaacatatggaccattaaatttgtatggtcttcagccgggtgaattccgtgcattaaagcctgaagaagtgcagttattaaagaaaaagtaaaattgaatttgtgaaataatccgaaggcgcattgagggggcagaagatacctggttttacgggaaactacggaatagtacggaaattgagccaagttataaacgttgacatgacagtaaaagcctattagaataggacttgtaaaaatataaaacgtttgtcttcaaggcgtggtgaaattcccgaccggcggtgacagcccgcaacccattgttaatggttgatctggtgtaattccagagccgacagtacagtctggtataaagaagatttctgtattaaataatctttaaatggtttatttgcgttgctgacaaacaaatgttaagtcagcaacgcttttttaatacaggatgccaaatggagacaatctcaaatggaggttgttattaatgacagtaacgcatcaacgtattcaacgattggtaggtatagcatgtttgggtgccttagcatttattttaatgttttttgagtttccagttttgccgatggcgccctaccttaaactggacttttctgatgtccctgttttgctagggggatatatctatgggccagttggtggaattattattgctgcaattaaatgtttaattcatggaaggattcacggcttttctccgctgaattaattggagttaccagcgacttcatttcatccctcgctcttctgcttccgttctgctgggtatggcgtcatcataactggagtaagaaaagacaagcgattactggaattgttttgggaacagtaatattgactgtcttaatgtccctgttgaacttgtggatccttacgcctttatatatggcggtttggaactggaagtcgacattaccagtatcccagttagtggcgattggtgtgttgccttttaacattattaagggtttggttgttacaattgtatatacaattattgcgggtcggttacgttcatggctagatcagcatagaatgatctaaaaagataaattaagagggttgagatttttcttggccttttattttttatggtagaatttttaaataaattacgtatataaatatatagggggtgaaatccgtgaataaattattgcgcttttttagctatcatcagccacggcgaattcgtgtaattgaaaacactctgcgaagccggcgaacagtcgcaaccctcttttgggcgcgacaatatggaatcttagaatggttaggggcagatcgaacactgaatcggcaagaatatgatcagcttattaatcaacttgttgctgataaactattagcgattgatgatcaatcccaagcaattcttacagaagagggcgcgaaagttttaaaaaacgaagaagagagtttctacatcccatcgttttacgactggtactggttaaccaatacgcaacgaataatccaacgactttttttagctattcaagttgtatcagaattctcttatcatcaaagaaagtatgttccattggcgatttcatatggtgaaatggttgcggtgaagcagtggtttcgacaaaattatcatcacgatctggttaagactctctatactgatctccatcggtttggcagcgcgttggaaagtgaagatccacgaatgacaacagacctttttaatgtcatgattggttatcagcgatcaggatggacaattaatcaagcagctcaagaattgaaaataaaaatcgacgatatccagtacttacgtcatgacgagatgttagcggttagcgcttatgctcgtaattttcctggtccactgcaacaattgctccttccgctgatcaatgagagtccactaaaccggagtgcccaagtaacgtttgacttatatacccagggagagccaattgaactgattgctcaagagcgacggttgaaagaaaatacaattagggagcatctcttggaagcggcaatccttattcctgacaagctagattgggatatccttttgccagaaagtaagcgtgacgaacttagtcgattctataagggcgaaccgaccgcatggaaatttgacgagcaaattgccagtttttatgaataccgcctatatcaaatatttcaaggaataacaaatgaaaaataagcaagaaattctagatgttttacaaaattattttggctttgatgattttcgtccaggccaagaagagacaattaacgccttactggaaggaaaagacactttatcgattcttcccactggtgccgggaaatcccttttatatcaattgccagcttatttattgtcaggaacgatcctcattgtttcaccgttaatttcactaatgcaggatcaagttgaccgtcttcatcggcagggagaaaaacgagtcattatgttaagcggccagcttgtcggaaaagagcgagcaagtgttctccgcaatttgaaatcatttaaatttatatttacttctccagaaatgcttgataaccagcaagttttaactgcacttaagaaaaataagattgcgttaatggttattgatgaggcccattgtatctcacagtggggtcctgattttcgtcctgaatatttattgctaaaggaagttcggcagcaattaggatcgccgacaacattgctgttgacggcaactgctacccctcgtattcgacaggatattttgaaaaaaatggggatggcgactgcttatcaggtaattaaatctgttgaccgtcctaacatttttttagctgttaagtccatcgctactcaaaaggaaaaggatggtgaacttctgaaactagttcaaaaattcactggtcccgggattatttacttcgcaagtcgcaagctggcttctcagatggcagaatggcttgaaaaccaaactgatttaaatgtggcagcttatcatgctggcgttgctccaattgaacgatttcgaattcaaaatcaatttatgaataatgaattacaggtgatatgtgcaacgagtgcctttgggatgggaattgataaaaatgatattcgttacgttattcattatcatttgccaagtaatttagagaattatttacaggaaatcggtcgggctggtcgtgatggtaagcagagtttggcagttcttctatatgcaaatggggatgaaatgattcaacggcaattaacaagcgtggatgtcccaccagttacagtcctagagcagattaagaatggtgagttatcagcaagtgttttgggggagcaagcatctttatttgagttttatcttgaacattcttttacaccgcagcaaataattacgatgttcgaacgacgtaaaattcaaacagaaaaagaattgcaagaaatggttgcttatatcaaagagaatggttgtaaacgagaatatcttttaacatactttggtgagcaatttgatggttcaaatgaattttgttgtgattatgagctttcagattgggcaactaaactgattttgccggtaagtcagccgctttctgaaaataataaagtaggatgggaagaccgcttaaaagccttattaaatattaccgaaagttaaagtttcatgttgttgctagacaatcatcaaaagtttgcgatacaatcagaatgttaattctcaaaataaggaggcatgattactttgagtgaggaacggaaagagagccgacgagctaatgatgaattatgggataaaaagtttacagataacgaagaccttgatagtgatggccatttatcacgaacagaacaccgtaagcaacgatcgcataattcaatgattactacgatcttaatcgtgttaattatcgttctcgccgctacaccacttatttattggattaataataaacagtcctttaatcatccggtgagaacagaacaagtagccgctagttctgaaaatagtaaaaaaaaagaatctcacagttcgagtacctctagtgagcattcaaagaaagaatctagtgtaagcagtagcgaatcctcttcttcaagtattgaagaatcaagttcgacgcaaaccagccaaagttacagtgctccgcaaagcagtagtagctattatcgatatagtagtagttatcgttacggtaatgggtatcaaaaccggactactcctaatcgctacagtagttatcagcagcgttataacaataaccaaacctataatcgctacaataataatgcagaaaatacaaaccgttatcgttaaaaatagagtattagcagcaattttctgataaagtagtgtattggattgaaaatagaggagtgaataactaataatgtgtaaaggattgcaagtagcaattgatggtccggcctcagcaggaaagagtacggtcgctaaattagtagcaaaaaagtttaattatgtctattgtgatactggcgcaatgtatcgagctgttacattagcagtattaaatcagggcattgatccaaaagatgataaaaaggttgctgaaattgctcggcaaataaaaattgactttgaacctggtgaaattgaacaaagagttttcttggatggcaaagaggtgactcatgatatccggttgccgaaagtagcggcaaatgtatctgctgtagcggcagttccagctgttcgtgaagagatgactaagcaacagcggcaaattgctgaaaatggtggaattgtgatggatggacgggatattggtacaactgttttaccacaagcacctgtaaagatattcatggtagcgagtgcctatgaacgggcacgacggcgatatgctgaaaaccaggcaaaagggattaatacaacgtcgcttgaagaattacaaaaagcaattgaattaagagataaaaaagactcaacgcgaaaagtttcacctcttacacaagcacccgatgcaatcaaattggatacaacaaatatgacaattgatgaagttgtgagtgaaatcagtaaaataattaaaaaaacacaagatgaattagcctaaatactggaaatgtgaaacaaattttagtaaaatatcttttagagttgattgttgcaaggaggattttttttaatggctgaaaacaacgaaaataaaaacgatatgttagaagcgcttgatagcattgaacaagttaaggtgggcgatgttgtcaagggtgaagttttggcaatcgatgacgatcgtcaagctatcgttggtattaaagatgcaggggttgaaggtgtcgtccctgctaaggaattatcaaccaagccagttgaagacatcaatgatgctgtaaaagtaggtgacgaattagatttagttgtcatttctaagatcggtaacgataaggaaaatggtagctaccttctttctcaccgtcgtcttgaagcccgtaaggtatgggatgacattcaaaagaaatttgatgaaggtgaacacattaccgccaaagtcactcaagctgttaagggtggattagtcgttgatgctggagttcgtggcttcgtccctgcttcaatgattactgatcactatgttgaagaccttaatcaatttaagggtcaagaacttgaatttaagattgttgaaatcgaaccaagcgaaaaccgtttgattctttcacacaaggaaattattcaagctcaacacgaaaaggctgctgaaaaggtatttgctgaattacaaccaggtgatgttgttgaaggtaaagttgcacggatgactaacttcggtgcatttattgaccttggcggcgttgatggattagttcacgtttctgaaatttcatacgatcacgttgacaagccttctgatgtattgactgctggtcaagatgttaaggttaaggtattaagcgttgaccctgaacgggaacggatttcattatccattaagcaaactttaccaggaccatgggatgatattgaagaaaaggctccagttgacagcgtattaactggtactgttaagcgtttgactagctttggtgctttcgttgaagtattccctggtgttgaaggtttagttcacatttcacaaatctcacacaagcacattgctacacctgcagatgttcttaagccaggccaagaagtacaagttaaggtaatcaatgttgatcctgaacaccaacgtcttggcttatcaatgaaggctcttgaagaacgtccaaaggaagacgaaaacaacaataacaacggtgaaaactaccgtggtcgtcgtcgttcacgtcgtaacaataacaaccggagcttcatgaataacgctccagaagaagaaagtggcttctcaatgggtgacttaattggtgacaagcttaaggacctacggaactagtttcttaaattaattatcttttaaggggaggctgggaattaactcagtctctttacttttttaaaggtatttatacagtagcgcggtagctggctggattccgaacgttgataaatcaacgtccggaacgcctagccatcctcgcgggggtgggaagacgaagtcgcaagcgacttctttcccactccctctttaatcatttaaaataaaatgaaagaaggtggaaagattggcaaatccaatcgtagcagttgttggtcgtccaaacgttggaaaatcaacattattcaatcgtattgcaggagaacggatttcaattgttgaagatactcctggagttactcgagaccgtatttatgctcatgctgaatggttaggaaaacattttagcatgattgatactggtgggattgaaatatcagatcaaccattattgacacagattcgtcaacaagcagaaattgctattgatgaagcagatgtaataatcttcgttgctgatgtagaaaacggtgtaactgatgctgatgagcaagtagcacgaattttatatcgctccaataaaccagtggtcttagctgttaataaagtcgataatccagaacgccgtagcgatatttatgattattattcccttggtttaggggagccatatgctgtttcaagtgttcatggcattggaatgggtgaccttttggatgctgttattaaagagtttcctgataacgccgctaatgatgaagacgactccatccactttagctttatcggtcgtcctaatgtcggaaaatcatcactagttaacgcaattttaggtgagaaccgggtaattgtatctaacgttgctggaactacccgtgatgccattaatactcaatttgaaacagcagatggacaaaaatttacaatggttgatactgctggaatccgcaaaaaaggaaaaatttatgagaacactgagcgttattcattaatgcgttccatgcgggcaattgatgatagtgatgttgtacttgttgtcctaaatgcagaagaaggtattcgcgaattagataagcatattgctggatatgcccacgaagcagggtgtggggttattatcgtcgttaataagtgggatacattaaaagaaaaagatcaccgaacgatgacagacttcactaatttgattcgacaagaattccagtaccttagttatgcaccaattattttcgtttcggcgaagacaaagcaacggttaaatcaattaccgggattaatcgaagaagtatatcaacaccaccgtcaacggatccaatcggcagtcttaaatgatgttttgatggatgcaattgctgccaatccgactccaacacaaaatggtcggcgtttgcgagtatactatgggacacaggttgcaaccgaaccaccaacatttgttatctttgttaatgatccagagttaatgcacttctcctatgagcgttatttggaaaatcaaattcggaaggcctttgacttttctggtacaccgatccatttaatcaagcgtcaacggcagtaaaagttaaagaattcattgtaaaatgaaaaaacattaaaaatgcggctagaagttgagaaaaccgcttgtcagcaggctttcactatgctaatcttaacaatgaaatgatacgaacttctcgtagttatttcgttaattttggaccactcaaaattaacattcacagacgtgagtttaacactctcgttatttgtgggaggtgaaacaacatggcaaacaaagcagaattagtaagcaatgttgctactgcaactggcttaaccaagaaggatgctactgcagctgtagatgctgttttcagttcaattcaagcatctttagctaagggtgaaaaggttcaattgatcggcttcggtaacttcgaagtacgtcaacgtgctgcacgtaagggccgcaacccacaaactggagaagaaatcaacattcctgcaagcaaggtaccagcattcaagcctggtaaagctttaaaggacgctgttaagtaattaacagttaaatgttaaaaagagactaggaaagaatttatccttcccagtcttttttctttttaaagacttgttcaatgcttaaaatcatcgattgtgatatatttaaaagtgatagtaaaaggagggcataatatgacctactcagaacaaatgcttgatcaattagaagcaggaaagttaaaagaagcccaaaactcatttaaactcgcactaattaatgatgatgatgatatgttatttagccttgcagaagaattatatgcattaggctttcttcaacaggcacgaacgatttacttaaaattattagatcgttatccagatgaagacgaattaaagactaatttagcgacgattgcaattgatgaaggacataatgacgaagctttatcatacttagcccagattaaaccagactcgccagcttatgttcaatcattactggttgctgcggatttatatcagactgaagaagaatttgaagtgacggaggaaaagttaaaagaagcttacgccttggctcccgatgaaccagctgttgaatttgcgctcggtgaattttactttatggttggccaatattctgaagcaatccaatattactttcaactaattaaaaatggatatactgactttgcgaaagttgatattgcgggacgtctagggatttgttacgctcagagcggtcagtttaagaaggctttagggtacttcaatcaggttaaaccggaataccagactagtgatattcgtttccaaaagggattgacccaacttcaattaggagatactgaaaaggcaataaagactttagaggatcttatcaacgatgataaccaatatgcatccgcttatcctgaactagcaaaggcgtatgaaaaggaaaataagtatcagcaagcattacgggttgtccaagaagggctcagtgttgatcaatacaatgaatacctttattcattagcagctgaaattaccagccaccttggcgatcaaaagttaatgaagaaatacttggtaaaggcgcatgaacttgctccagagaatatgacgattactttgcaatatagtaatttcttgcttcaccaacacgatgatgaggcaaatattaaactcctgagtccattggtaaaagaagatgaaacagatccacaattatattggaatctaacgcggtcatatcaacgaactgatcagcttgaattagccggaaaatattatgaagctgctttgccggcatacagtgaaaatccaacattcttaaaagaattaattaattactaccgcgaaactggtgaaactgataagttaatggatgaattggaacactatcttcggttagtcccaacagacactgaaatgcaagatctttatgaccaatatgaagattacaaataatttttaatttaaatgagacaggaaacgttaacgattttaaccgttctttacgcttcctgtctctttttagtagtaacttaatttgttataatcaactttgattatcaaaatgaggacatgattaaatgaaaataaaacaattaccagctatatttgaaccagcacgacctgtcttacaaaaaatagaggaggctggctacgaagcatattttgttggcggttgtgtccgtgacactatcttgcatgatgagattcatgatatagatatagcgacgagtgcttaccctagtgaaataaaggcgatttttaaccatactgttgataccggaattgaacatggtacagttatgattctcgaccatggaacgggatatgaaacaactacttttagaaccgagtcaggttaccaagactaccgccgtcctgataaagtaacttttgttcgttcattaagtgaagatctccagcgtcgagacttcacaatcaacgccctcgccttacgtgaagatggggaagttattgatctatttgacggactagaagacctgcaaaaacatcttattaaagcggttggcaaccctaatgaacgttttcatgaagatgctttacggatgatgcgggccgtgcgttttgcaagtaagcttgattttgtcattgatactgcaacgttaaaaggaatcaaagaaaatgcaccattattagaaaaaattgcagttgaacgaatccgggttgagttagaaaaactattgttgggtcaaaatccagtagcgggcttaaaagattttattgcgactggattgtatcaatattgtccagggttggaaaatgctcaagctgctttatcggctttattaatccttaaccaatggcatttggaaaatgaggctcaattatggtcagttttaggcttacaactccagcttgatcaaaaagaaattggtaaattcttaaagaagtggaagacagcaaatgatttaattgcacaggtcaaaaaagtagttccagcagtccaagcaattcgtcaacgtgcgcttacaccaacactaatgtttaataccggtgaaacagccctccatgatgctaaccaagtagctaagttatatggatgggcaattgatgatgaagaattgcaaaaagcttatcaaaagttaccaattaaaaacgctaaagaattagcaattgatggtcgagtattaattaccaaagcgggggtaaaaccaggaccattgatggggaagattcttcagcaattaacgctggcagtggtaaatggtgagatagctaacaatgcaacagtcttattagaaaaagtagaagagataacgaaagagggataatatgcaaacaatgcgtgcagagggtctaaccagcacatacggtgagaagaccttatttgatgatatttcgtttattatcaatgaaaatgatcgaattggactgattggtgttaatggaagtggaaaaaccagtcttcttaacgtaattagtggggaagtaaatccagaaggcggcgggcagatcactaagcctaatgattacacgatcggttatttaaaacagcagcctgaacttgatgaaaataaaacaatcatggaagctgtttttgaaggtaaacaaccagtctttgaaacaattcgtcaatatgagctggctcttgaacgttttacaaagcatccagaagatccacaagcaatcgaccgttacacaaaaatgcaggcacggatggaccaagaagatgcatgggaggcagatagtcgggtgaagacgattctgacccagttaaagataaaagatgtaagtcaaaagattgctcaactttctggaggacaaaagaaacgggttgggttagcgcaagtcttaattcaacagccagacctcttattgctcgatgaaccgactaaccacttagaccttgattcggtagtttggctccaggatttccttcgcagttataagggtgctgtcctcgttgttacccatgatcggtacttccttgatcaaattacaaatcatatctgggagctatcttttggtaaactttatcactacgagggaaattatcaggactttgtagcaaaaaaggcggaacgagtagagttagctaaagatactgagaaaaagaatcaacagctgtataaaaaagaattagcctggatgcggacaggtgcaaaagcccgttctacaaaacaaaagggacggatcaatcggttccacgaattagaaggaaaaatcggtaatcttaaaaccgatgaagatattgctatcaatcttggatcacaacgtctagggaaagatgttattcaatttaaggatgctaacttaaaatttgataatcaccaaatcctccatgacttcaattggcttgttcaggcaggcgatcgaattggaattactggtgaaaacggagcgggtaagacgagtttattaaatgtgattgcccaacgtgttcccctagatagtggtgtccttaagattggggaaaccgttaagttagggtattatacccagcaaacagaaggaattgacaatgataagcggatgattagtttcttgtctgaaattgctgataatgttactgataaagatggcaataagctcagcgttacccaattattagaacgcttcttattccctcgttttatgcatggtactttgatccgaaaactttctgggggtgaaaagcggcgattatacctcttaaagatcttaatgcagcagcccaatgtcttattactagatgagccaactaacgaccttgatattggaacattgacagttcttgaagattacctagataattttgcgggaactgtaattacggtttctcatgatcgctatttcttagataaagtggctgacaacttgctagtcttcaacgggaatggagatattgagcgttatacgggacgctttactgattatctaactgctaaaaaggaagaggcagataaggataaagggcttaaaaatgatcaaaaagcccttgccaaaaagcaggtaaataagcaagaaccagctaagaaagaaaaaacaaaacttacttatgctgaacaacttgagtgggatcatattgatgaagaattagatgcccttgatcaacagcatcagcaattagaaaatgaaatggctgaagcagcaagcgattatacgaaaattgctaagttacagaagcagctaaatgaaatacaagaaaaaattgatgaaaagacagctcgttgggagtatttaagcacatacgttgacgagtaaaggaagggacaaataaggatggcaacaaatgtaaatgaagagcaatacttagacttaatccgttatgttttggcgaatggacatcaaaagggtgatcggacaggaacaggtactaaatctgttttcggatatcagatgcgatttgacctaagcaaaggttttcctattttaacgactaagaaagtcccatttggcttgattaagagtgaattactatggtttttacgcggtgataccaacattcgcttcttacttcaacacaagaatcatatttgggatgaatgggcatttaagaagtgggtggaaagtgatgaatatcaaggtccagatatgacggactttggtcaccgctggcttaaagatccagagtttaagcaggtctatcttcaagaaaagaaggctttctgtcagcgaattcttgaagatgatgattttgcccaaaaatatggcgacttaggacttgtttatggaagtcagtggcgaaaatggaagacgagtcaaggcgacacaattgatcaaattgctaatgttatccagcagattaaaactactccggattcacgacggatgattgtttcggcttggaatccagaagatgttccttctatggctctccctccatgtcacaccatgttccaattttatgttaatgatggaaagcttagttgtcagctctatcaacggagtgccgacatctttttaggggttccattcaatatcgctagttatgccttattgacgcatatgattgctcaccaatgcggtttagaacctggcgagtttgttcatacattaggggatgctcacatttatctgaaccatcttgatcaagttaaagaacagctgacaagaacacctcatgaagctcctaaattgattttacctgctgaaccaaaaccaatcgatcaatatgaaatgactgatattaagttagaaggctatactcatgagccggcaatcaaggctcccgtagcagtttaaaaggagtggttcaaaatgagtgagctgaatttaatctgggccgaagatttaaatggctggattggcaaagataatacaattccatggcatgtttctgctgatatgaagcattttaagacaaagactactggtcacccaattataatggggcgaagaacttttgcctcacttggcaataaaccgttgcctaagcgggaaaatattgtgcttaccagtaggaacatagatgctgaaggagtggaagtcgttcattctttagctgcccttaaagaatatcttaaagcaaatccaaacgaatattttgtaatcggtggggcaacgatctatcagcaattacttccaatggcgacaaagctaacacgaacggtgataaataagcaaattgttggagatacaaaaatgccaacgatcgattatgaccgttggcacttagtaaatcacaataattatgaaaaagatgaccagctaatttgtcgttttgaagaatgggaactaaacgtataaaagaattgaaaaatacattaatatcgtgccgatgaggacaaaaatatgccaaatcaaatgggtatatgccgttggacgactgtaaaagagggccccaagagtaaaggaaagtcctcctagtaaaagcaagccgaagccaactggaccaagtgcacgccagagaggcatgaaggcgactagacatagccagcccataagaatgtaaataatggttgaatatttacttttatgttttaaccaaatacatttatacacgattccgataacggataggccccaaatcactccgaaaattgtccaacctaaccagccgcgaatgctaactaagcaatagggggtataagttgcggcaataagcacaaagatcattgaatggtcgagaatttgaaaaacccgtttggctcgtgtaaagatcaaggcatgaaataaggttgacgaaaggtaaaaaagaattaaagcacttccgtaaatagtaaaggtaacaattcgcatgggactaccagtatgaacagctctaataattaacaagatcaagccagcgatcgatagtcctgccccgatcccatgagtaaccgcattacctatttctattaacaaagtacgccgatctcttgtctctttttgtgtatccatcaaaaaacccctttccaaagaccaatgaatttttaaaatatttttgttatactaaataaatagtaattgatcctacaaaattagataaaatttagtataatagtacttgaaataaaatatctagttctcaatactagataattatagcacaaattgttcaggaagagtggtaagtttcatggcaaagataaaaattgtttgtgactcatcagcaggattaactgatgaagaaattaaaaaatatgacattacaattataccattaagtgtaatgatcgatgggacggtatacgttgagcgtgaaacaattacaaacgaacagttccctgaaatgatgaagaatgctaagtcactaccaaagacttcccaaccaccaattggaaagtttgtcgatgcgtttgataagctaggcgaagatggtagcgaagtattatgcgttacaatgatggaatcaattagtgggaccgtccacgcggctgaacaagcggctggaatgacgaagacaaaagttacagtctacgattctcaaacgactgatcgggcaatggcttttcaaatcattgaagcggcaaaggtaattgaaaatggtggctcagttcaagaggctattgaacgaatgaagtatatatttgatcattcaaaagtttatttggcaattgataacttagataatttagttgctgggggccgaattagtaagtttgctggtgctttgtctaacttactaaatatcaaagtgatgcttcaaattgctgatggacaaatccatattattatgaagggacgaggaaagaaagctcttcataaggaatgggatcgaatcttgaatgaaatgaagaatgggccaaaagttatgggtgccggaatctcccatgttgaagggaatagtgaggttaatcgtcttctaacaaagatcaaggcatttgagcctaacttagacatcgttgttcgagagacagtgccaattattgcaacccacactggaatgggtgcttgttgtttgctatactatacggaataatctttgataaaaataagtggaggctgagaaaaatgaaaatttttcccagcctctatcttcttaaaattttaaaataaaggactatagaatagatgaaaaagtggactaaatggctattattatcgcttttggctattatgattattggtggaggatggtatactgttaaccactttacaaatttaactagtaatagttcaaaagttgttaaaccaaaatatgttgaaaagaaaaatgtaaagcttgttgcactaggtgattcccttactcacggtcaaggggatgaaactaataatggtgggtacgttggcgtaattaagggaaaaatcgaacatcgttaccaccaaactaaggtgacaacagtcaattacggggtaacaggggaccgatccgaccagattcttgaccggttaaatcagcaatctcaattacgtagtgacttacggagcgcggatgtgattacgatgactgttggtggaaatgatctaatgcaaatcctggaaaaaaacgtaatgggctctgaacggcaagttaccagtagtgttgaaagtggcgaaaagacttatcaacaaaaattaattaagctatttgatgcagttcgaaaggaaaatcctaaggctcctatttttgtaatgagtatttataatcctttctatacctatttcccagatgtaacaattattaacaagtcaattaatcaatggaaccaaactacgcaagatacaatgaataattataagtcaatgtattttgtgaacattaataagttgatgtcatatggtcagtatcagactaagagtcagcaacaacagctgatcaaggaagaagagaaggctaaccaagggcaggtcagtcaaaagcgggtcattgaaattatgaatcataaggataagaaccttaataaatatatttcaacagaagataatttccatcctaatcatacgggatacgtcgaaattgctgaccaattatttaaggtaatgcaaaaacatgatagctgggaattcacacggaggtaaaaatgaaaaattctgaagaaaaaaagattaattggtggaagtgggcctttttttgcttagtagccttgattgtaattagctgtggggttgtattgaacaaggcgactgcaccgacccctgctactacaactagcaaagcagtaaagccaagcgattcatcagtaacggttgaattgaataaaaaacaggtgaatgctttagctgctaattacctgaatcagtttttaaaagggcaaaagatccgttatgattttattgttggcgatcagtatgctaccctgacagggaatactaagtttctaggggctaaagtgcgatttgccattaactttattcctgaacggttaagtaacggaaatgtcttgttgcgggctaagggactttcagttggacggttaaatatcccaatcaaatttgtgatgggttatattgcaaagaattataatattcctaaatgggtaacaattaatccacaaaagaagacagttttattagaccttaaccgttatagcaagcaccgttctcttaagtactcagctcaggaaattaacatgcaagaaggacggtttaagtttttaatcacggtcccaacaagcaatgaataaatattggaggaaatcaaaatgagaatgagtttttatcagtttttaatgactcaacgaaacccgaatagtgcagatgaagttcaacagtttgcaaacaacgctttttttgatactacttttcctaagcattcagaggattttgatgaaatttcgcattatttagaagaaaatgctgactatttgccatcaatgacaatttttgatgaagcttggcaacggtatattgatgcaatgaattagaaaagaagggagaaagtcaaatggcaacaattcaatggttcccaggacacatggcaaaagcattacgccaaattcgtgaacaaatgccactagtagatattttatttgagctagtagatgctcgtgtcccttattcgtcacaaaatccagaagtggcactagctgcaggagaaaagcccaaacttttaattatgacaaaaacggacctagcagatcaaaaacgattaaatgaatggattaaatactttgagcagcataatcaaccagttcttgccctcgattcacgccaaaataacgtggcaaaagttgtaacggctaaaagtaaagagatattaaaagataaattggcagaagaaaaagccaagggaatgaaaaagaggccaattcgggcaatgtgtgttggtgttcccaatgtaggaaaatcaacccttttaaatcacctggtaaaaaagaacgttgcggctactggaaaccgtcccggagtcactactggacagcaatggttgcggtcatcagcagaattggaattactcgatactcctggtgtcctttggcataaatttgctactcctaagcaagggataatgctggctttaacaggagcaattaaagatagcttatacgcaaaggatgatgtagcgttgtttgcccttgattacttgcggcagcaccagtcagaagtgttaaagcaacgttaccacttaactgatgcagatctggatgaatcagttaccaatccagatttactattaacgattactgctaaaatgggctttcgtgatgattatgaccgggctagtgaacggttgatttttgacttgcgaaaaggaaaattaggaccaatcactttggaagtacccgctgacctaaatgaggatggactaaatgaataaggaaaccattagtcaaattaaggcccgtttacaaactatcacagatacaactgatccttacttgcaaactattcatgatgattcgcgaaaaggtgttcaaacggcaattcagcaatttgagcggcggcttgcacggcagaaggaagctgaagaggcgttcaataaccggttcaaatacgaaaagtactattgggaaaatggatgtcagtatattgcagggatggatgaagtaggaagaggaccattggctgggccagtggttacttgtgcagtaattttaaatgcagattttgacctgataggggtaactgattctaaacaattaactaggcatgaacgggaaaatttatatttacggattgttgatgaggcggttgaagttagcatcgcggtgaatgatgcgccagtgattgatcaaatgaatatttatgctgctacccaggatgcaatgattcgggcagttaatcaccttcaccatcggccagatcatctgattgttgatgctgtcccgttagcaattgatattccccagacgactttgatcaagggggatcaaaagagtattagcgttgctgcagccagtattgtcgcaaaagaataccgtgatcacctaatgcgagactatgattatgtttatccagggtatggttttgcacaaaatatgggttatggaactaaagaacatttagccggcttagaaaaaatgggggcaactcctattcatcggcgttcttttaatcccgttccaaaatatttaaattaaaaaatgcattttcaaaaagctttcgtatataaatataaggaggcttttttatgttacaagtaaacgattttctattacggttaagtttgtgtcgcggaattggcttagtttcaaagtatcgcctatgggaatgtgctcgacaggcacgctgctttaataatattgactatttgattgaccatgcaaatgttagcttacgaagtgcatcgtcattaaaaaataattgggccagtccagagcttgatcaagcagtggccttaaacagtcaggaacaatttattacgattgcggatccgttatacccgatgaccctgaaagaaacgtactgtccgcccttggtattgttttatcgtggtaatctgagcttgctccatcagccttcaattggtgttgttggcactaggcagataactaattatggacagagcgctttacgaggattgctgccaccagtaattaagcggcagatagtagtaatcagtggtttagctcaaggagtagatggttttagccatgaactggcgctaaaacatggtggccttactatcggagtgattgggacgggtttagatcaagcttacccacgaaatcaccaagtccttcaagatgaggttgccagacaaggattagtaatttctgagtatgggcggggtgaaccacctgtggcttatcacttcccagaaagaaaccgaattattgcaggtttaagcgaagtgattttggttgtcgaggcaaagaaaaggagtgggagtttaatcacagctaatatcggcttagatgaaaatcggtctgtatgtgctattcctggaaggattgacgctcccttatcggtaggatgtaacagtttaatcgcagctggcgcgaaaccaattctcagcgcccaagatctgctagatgagtttcggctgtatgattcaagaccttgatttctggtaagaagttgattaaaatattttgttcagttagagattatatttgacagatggtagtcaaatggattaataatattattgaatgaaatattaaaaatgttaggagcctaccagaatggcaaccaaaacaaccaaatcaacggcgaaaaagacaactcgtcgccgttcaaaaactaaaaaaaatctggtgatcgtggaatcaccatcaaaggcaaaaacaatcggtaaatttttaggccggtcctataaggttgtggctagtttaggccatattcgggacttgccaaaaagccggatgggggtagatattgaaaatgattacacccctgattacatttcaattcggggaaagggtgatgtaattaaggaactacggaaggacgctaaaaatgcgaaagccgtatatcttgcatctgacccggaccgtgaaggggaagcaattgcctggcacgtttcaaatattttaaagcttgacgatgatcaaaagaaccgggttacctttaacgaaattactaaggatgctgttaaagaagcttttaaggaaccccgagagattaatatggatctcgtagatgcccaacaggcacgacgggtattggatcgattagttggatattcaattagcccaattttatggaagaaagtcaaaaaaggcttaagtgctggtcgtgttcaatcagttgccctttatctgattattcaacgtgaaaatgaaattaaaaacttcaaaccagaggaatactggacaattgatgctgatttcaagaagggcaaagaagaattcaaggctagtttttacggtgaaaatggtaagaaggtttccttgaagaataatgatgacgttcaggcaattctttctaaaatcgataaaaagaaagatttcgatgttactaaggtgactaaaaaagaacgtcggcggcaaccacagccaccatatacgacctcgaccatgcaacaggatgctaaccgtcgtttgaacttccgaacacgaaagacaatgatggcagcacaaatgttatatgaagggatcgacattaaagaaggagcaccggttgggttaattacctatatgcggacggactcgactcgagtggcgtcaattgctaagcatgaagcatctaactatattcatgaaaactatggcgcggaatatgcggcaataaaaccggttaagggtaaattacctgagggggcacaagatgctcacgaagctattcggccaacttcagtctatcggacaccagctaaaatgaagcaatatttaacctccgaccagtataaactttataatttgatttggtcgcggtttgtggctagtcaaatgactgcggaagtaattgatacgatgagcgttaacctccagcaaaatggggttgatttccgtgcaaatggatcaaaagttaagttccctgggtttacgaaagtatataagcgaggaactgaaaaagataacttgttgccagaattaactgaaggtgacaaggcaaaaatgataaaggacgatccagctcagcactttacccagccacctgcccgttatacagaagcggctcttattaaaaccttggaagaaaatggcgtcggtcggccatcaacctatgcgccaacccttgatacgatccagcgacgttattatgttcgccttgtatcacgccactttgagccaactgaactgggtgaaattgttaaccgaattatcgaaaaacaattccctgatattgtcaatgtccaatttactgccgatattgaaggtaaacttgatgagattgaagagggcaagcagaactggattaatgttgttgataaattctatcagccattctcaaaagaagttgatgcagctgaagaagaggtcgataagattgagatgaaagatgagcttgctggcacagattgtgaaatttgtggagcccccatggttattaaaatgggtcgttatggtaagttctatgcatgttctcgcttcccaaattgtcggaataccaaagcgattgtaaaagataccggaattacatgtccaaagtgtgggcaagggacggttgttgaacgaaagtcaaagaagaaccgaactttctatggttgttcccgttatccagattgtgactttgtttcatgggataaaccaattggacgtaactgtcctaaggatgggcacttcctcgttgaaaagaaagtcaagggtggtaaacaggttgtctgtccaaatggggattataaagaagaagttcaaaagtaaaaattatactttattttttactgaattttacttaaatatttattgaaaaggtttccaaaatctgctattgtgcgtttggaaccttttttatatacttaatgttaaacgattatcaattgaagggatcgataacaatgattactttacaaaaccaacaattaattgtgcaaattgatgaattaggtgctcaattacatagtattaaacggcaggataacgaaatcgagtacttatggcagggggatcctgcttcatggaatcgccaagcaccaatcctttttccgttcgttggccgcttaaaagatgatcaatatcaatatggcaaccaaacttatcatcaaacacaacatggttttgcacgtgatcgaaaattccaagttattgagcaaacaccatcgatggttgtgatggaacagcatgatgatagtgaaactaagaaggcttttcctttttcatttagtcttcaggtaaaattcgaattagttgttgataaggttgaaatcagttatatggtaaaaaacccgagtggagatgaaacattaatctatgctattggagcacatcctggttttaatatgccattaactggtgtcgggagttttgaacaaacagaattaagcgttaaaccggcaacagaatattcacggatcgttttagatggcgcctataacgattcaactcatccaaaattgattgatatgaaggattcattatcacttaatcatgatctttttaataaggatgctattattttcaaaacagatggcggccattttacagccaaattaacagatactgttgctaatcatggggtcatagttgatacctttaatacggaatacgtgggagtttggtcgcaatatccaagtacagctccatttgtatgtgtggaaccatggtggggaatagcagataatgttaatgctgatgggctccttcttcacaagcaagggatgcaccgtcttgcaccagatgaaacagataattatcactttagtattaagccattttaactaaaaaataggagaccgtgaaaatgattatttccagtctcctatttattttgttttttttctcgtaaataatagccaaggccaaaacttaccatcgattcttttcctgataaaattcggtgaatgtttgatcggtgacggtaaaagaccactcctgttaatattcctgccacgattgctaaaatccaagcatgaatgaagagggcaataatgaaaattgcactaatcccaaccatactggcggcactaaccatacttgtcaagcacaagacaaagataaaaatcaaacaggcaacaacaaagaggagggggttataggctaatagaattcccgcgctagttgccacagctttcccaccatgaaaattatcgaatattgatacagtgtgaccaagactagcaaagagtccgatcaatagtgggttaacggttccagatatccctaaaaagtatggctgactggcagcgagtgttccctttagaatatcgataaataaaacaacaacgcctgccttaaaccccaatgtccgaaaggtattcgttgttccgatattaccgctacctaacttgcgaatatccttatgataaatatacttaccgatccagagaccagttgggattgaacctaataggtaagcgataataatcatcccaataatttcaaaaaacatataaatagctccttaataatagcttatacagcttttaagcatagcatgaatatttaattttaaccactaggaaggcacaatttgccattctccaaagttttcagtatcattttaattatgaattgaaattgtggccagtttagctttacaattaacaaatgtaaatggtaaaataatctttcgaacatacgtttaggtataatattggcaatgggaggtcattttgtggccaaagaagaagtaaaatatgatgcctcatctatacaagtattaaaaggacttgaggcggtacgaaaaagaccagggatgtatattggatctactgattctcgtggattgcatcacctggtatatgaaatagtggataatgccgttgatgaagcgttatccggttatggtgatgagattaacatcatcattgaagcagacaatgcaattacagttcaagatcatggtcgggggatgccggtgggaatgcatgcttctggcaaaccgacacctgaagttattatgacggttcttcatgctggaggaaaatttggtcaatcagatggttataagacttcagggggacttcatggtgttggagcttccgttgtaaatgccttatcatcacatttgaccctgacaattgtccgtgatcacgtccgttaccaagaaatttttaaggatggcggtcaaccagttggaacattgaaaaaattaggaaaaaccaaagcggagaacggaacgaccgtctcatttaagccggacccgaagattttttcaactactgtttatgactataataccttagctaatcgtcttcgtgagtcggcctttttattgaaagggattaagattacccttaccgataagcgagctggtcaagaaaaacaagatgtattccagttcgccgatggaattcaagaattcgtttcttatcttaacgagggtaaggatgttttaggaaagacgctttactttgatggaaaacaagacggggtcgaagttgaagtggcagctcaatataatgatggttattctgagagcttgttatcatttgtcaacaatgttcgaactccagatggtggtactcatgaagctggattccggagtgcctggacgaagactttcaatgaatacgcaaaaaaggttggtctgttaaaggctaatgataaaaatctggaaggtagtgatgttcgggaagggttaacagccgtgatctcagtccggattccagaacgtctacttcaatttgagggtcagacaaaggataaactgggaactcttgaagcacggaaaattgttgatgcgattgtcagtgagcagcttaactatgccctaatggaaaatggtgactttgcccagatgttaattcgtaaggcattaaaggctcgtgaagcccgagaagctgcccgcaaagcccgtaaccaagcccgtggtggcaaacgaaagggtaaaaaggaacgaaatctttctggaaaattgactcctgcccaatcaaaaaatgctaagaaaaatgaattattcctagtcgaaggggattcggccggtggttcagccaaacaggggcgtgaccgtaaattccaagcaattttaccattacgagggaaagtgctaaatacagaaaaggcgaagttagatgatgtcttaaaaaacgaagaattgaatacgattatctatactgttggcgctggtgccggttctgagtttaatgttgaagattcaaattacgataagattattattatgactgatgccgatgatgatggtgctcatattcagatccttcttcttaccttcttctacaagtatatgcggccaatgatcgaagctggaaagatctatattgctcttccaccactttatcgtttgcaacgaggacgtggagctaagactaatatcacatatgcgtggactaatgaagaattaacaaaattgactaaaaagatgggtaaaggagcacagttacaacggttcaaagggcttggtgaaatgaatgccgatcagttgtgggaaacaacaatgaatccagatacccggacgctgatccaagttcgtatcgaggatgctgaattagctgagcgtcgtgtaactactttgatgggtaataaggtggaaccacggcgagaatggattgaagaaaatgtccaattcacgttagccgatgatcaagaatccgatcaattagttgagaataaaggacaattacctcaaactaaaggaccgacaattagtacatggaataaatagagaagggaatcaagttttgtgagaaacggaaaaattgaacatatgacgctcgaacagatcatgggtgatcgttttgggcgttattccaaatcaattattcaagaacgagctttacctgatattcgtgatggattaaaaccggttcagcgccggattttatttgccatgaataaagatggaaatacttatgataaagggtttcgtaagtctgctaaatcagttgggaacgtaatgggtaacttccacccccacggtgatagttcgatttatgaagcattagtccggttgagtcaggattggaaattacgtgaacccctaattgaaatgcacggtaataatggatcgatggatggtgatccaccagctgccatgcgttatactgaggctcggcttagtaaaatagcaggtttaatgcttcaagatatcgacaaagatacagttgagatggccttaaacttcgatgatactgaaaaggagccgacagttttaccagcacgtattcctaacttactcgttaatggagcaactggaatttctgctggatatgctactgagatcccaacgcataatttaagcgaagttcttgatgcattgatttatcttatcaagcatccaactgcttctttagataagttaatggaatttattcctggtcctgatttcccaactggtggaatcattcaggggattgatggaattcgtaaggcataccagactggtcgcggtcgagtggtagtgcgagcaaaaacggaaattgaaaccttacgaggtggtcgtcaacaaattaatgtgacggagattccttatgaagtaaataaggcgcaactggttaagcgaatcaatgatctgcgccttgccaaaaaagttgagggaattgcggaagcccgcgatgaaactgatcgtagtggattacgaattgcaatcgaactcaagcggggagctaatgcaaacggcattcttaattacttattaaagaacaccgatttacagattaactataacttcaatatggttgcgattgatgaccagcgaccaatgcgtgttggcttgaagcgaattttgacttcctatctcgaattccagaaagagattattcgtcgacggacacaatataacctaacgaaggctcagcaacgtttgcatattgtcgaagggttaatcaaagcactatcaattttagataaggtcattaaaacgatccgcgcaagtaagaatcgtaaggacgcaaaggaaaacttagtaaaagaatacaacttcacacctgagcaggccgaagcaattgttaccttgcaactttatcgcttaacaaatacggatgtaactgagctagaaaaagaacaagagcaactaaactcgcggattaatgaatatcagttaatcttaactaacgaaaatgagctagcaaaagtccttactaaggaaattagggccatcaagaaggaatttggcaatccgcgacggactaagattgaaaatcatgttgaaaaacttgagattgatactaaagttacggttgcaaatgaagatgttgtagtcttggtttcacatgcgggctatatcaaacgaagcagtattcgctccttcaaggcttcggaagcagaagaaaacggtctccgggaagacgattacccattattgattcaacaaacgaataccttatcgcatttatttatgtttaccaaccttgggcatattatttaccgcccaattcatgaaattgcggatgcgcggtggaaggatactggcgagcatatctcacaaacaatcggcttagcagataatgaagagatcattaaggcaatgatttttgataaactggatcaaccgggaacaattatcatgggaaccagcgatggtcaagtaaagcaaacggcctttaatgactataagcccggttctcgttacaagagtcatgcaagtgttgcaattaagctcagggataatgcgcaagttgtaaatgttgattactatgaaccaacaaatgagaattgttcactattgacgattagtcgccaaggatatgcggtgcggtatgatgtcgcagatgttcctgtaacagggatccggacagctggtgtacgggccattaacctgaaagatgatgaccaagtggcagaccaaatcttggttaaagatggtcaagatattgctgtaattacccaacgaggtgcatttaaggaaatgcccgttgatgagattgaggttggggcacgagcacgacgaggagaacttgtccttcggaggttaaaatcacatcctcatgaaattgcggacttccttgcttatgaccctgattatcagggagcttttgaggctattactaaccggccggcattccaagatataatggctaccgaccatcatctaagttcgatcaagtcaaacgggacttttgtaatcgacaccgatacgcaaggggaaccagtaaagcttcgattgaaacaaactaatatcttaacggaagaacctgttagtcaaagctaagaagaaggcgaaaaatttggcatacattaaagaaattcgtgatctggtggggcatcgtcctttaatcatgactagtgcttctggagcgcttttagaccagcaaggagctgtcttgcttcaagaacgcgcagatactggtgattggggctttccaggcggctatatggaatttggcgaatcttttgagcaaactgtaaagcgcgaatttaaagaagatgcgggaattgaaattgtgcctgtcaaacaactagcaattcttgaccaagatttttatacttatcctaatggtgaccgcgttcaaccaattaatgcattttacttagttgaagaaactagcgctaaacattatcagccaaaagttacagaaacgacaaccactgaatatttttcattagatgaagaaccaccacgcttttttaacggccagcatgaacaaatgtggcagatcttaaaagattttacccataatagaaaagatatttaataattgttctttaatctattaacttccatgatagaatagaaaatgtagattgtttcacctactagaaataactaggattaaagtagtgaacaaacaggaggaatttatatgagcaaagaattagtatttggacaccaaaagcctgatacagatgcgattaccgctgcaatggcattttcatacttccaaaaccaattgggatacgaaactgaagcagttgctttaggtgaaccaaatgatgagactaagtttgcattgaagactttcggtatggaagcaccacgcgtaatcgaaactgctgcaaacgaagtagataaggtaatgcttgtagaccacaacgaaccacaacaaagtgttagtgatatcgacaaggtcactgtaacgcacttagttgaccaccaccggattgccggctttgaaactgctcaaccactctgggcaactgttcgtccttacggttgtgtaagtacaatcattacagaattgttccaagaaaagcacattaatattcccgctaacttggctgggatgatgctttctgctatcatttctgataccttgcttttgaagtcaccaactacaactgaccacgatcgtgaagctgttaagtacttagcaaagatcgctggtgttgaagattacgaaaagtacggcattgaaatgcttaaggctggtactaaccttggtgctaagtctgatgctgacatcgttgatggtgatgctaagacctttgaacttggcggcaagaaagttcgtattggtcaagttaacactgtcgatttagatgatgtttttgctcgtcaagctgatcttgaaagtcaaatgcaaagtatgatggacgataacgattatgacttattcttattaatcgctactaatatcttaaacagtgactcagaattattagttattggtgatcctgctgaaaaggttgaagcagcctttggtaagaagcttaacgaaaacaagcggatgaatttaccaggtgttgtatcacggaagaagcaagttgttcctcctttgactgatgcattcgaaggttaataaataaattaaacctgaaatgtcaatttaaattagaaaaaaggtgaaagttgttcttctgtgacatgactcaagaatacttctaatggtgtacgataattaagagattttcgtgggatattgttgcgacgatgcattagctgagtgactagttcgtctggtaaatcgcgaaaatctagctttttactaagaccatcacgacgcaagaggccgttattattttcgtttaaccctcgttgattgggagcaccgacttccgcaaaataggtgtgaagatcatacttattggctatttctcgccatccagcaaattctttcccgttatcaaaagtaattgatttaacaaagtgacgtggcagtttagcgagccattgatcaagctggcaattcactgcttcgtctgttttatgatgaatattaaggacaatcattactttggattgtcgctctactagcgtcattaccgctccgcggtgagctttaccttgaactgtatcagcttcaaagtgcccaaattcatgttggtaatgcggaaaatcacgatatcgttgatagatactgcgtcctaattggccagctttaccacgatgttccacatagccattgggatggcgttttcctttcatcggtagctgtttaacggaaaagccatactgattgcgggcaaacatgcgataaagggtgcgcatactgcagctaattgggtgttcatgacgaccaataatagtatcaggagtccaacctgccttgatttgcgcatggatatagttaacttcgatagttggcagttgggtctgcttccgaccacaacgacgcttatgtcgctgataagtctgaagatattggtcgatggttttaccgtcgttgaggaaacgataaacacgatagatggtttcttgactacgctgaagtaatttagcagcccgataagctttagtaccttgataccaaaaatcagctatgagagttaattcacgtgtggtaagatgtttataggtcatttgtgattgcctttcttttgattagggatattcaaaagtctatcacaaatggctttttattttttctaacttaattttacaaacgacgaaattaaaaactgaggaaaatcgcaaaatttttctcagtttttttgagctttaaatttcaaagcttattcttaattagttaaaatataagtactgattttaagaaatggggttgatattaatgaatatcacatttactgatcaagctattgaacgtttacagcgttatgaattatcttctaagaagatgctcctagattttgatgatggggtgggcccattttctgccgttgggagttgcagtttagatggtgattatcgactaatccttgttaaagaggatttagataccccagattataatgaaaaaattacctctaatttgggggatgtttttattaaagaccatacagcagttcaatttgatgatgaaatggaagtaaggtttaatccgcgatactttacaatgccacttgtcagtcctaaacgcgttttaacggataatcttgaagttctggatcttagtaagacagacttaaattctcaaattgatcgagcgcatgattgctaacaatataataagggagcgtgatagaagccagatacgacttcatgatcatgctcccttattgcttttaaaggataatcctgaaaataaaagtgatgataattgcaaaaattccaataatcgttgcataggaaaaatgtttacgttgagctggtttaattaatgcttgcctcccccatgaaaattgtgaataaagcccataaaaaagcggcaataagcaaaatatataatttccagttaattggaagatgatggtaaaaatcgccataaaataccatcatgccgataaacatcacaatagcataggcatagttatcgcggtgaaagttaaaattaaaaagataagcaaacgcgcaaaataataaaatactaataatatcgtttaaaatcataccctctacacacttccttatggtttttattatagtcattaacaggataaagataaaatattaagaagcaatcgcaaataatatgatatgatggtcttgttagaattaatgaaggcggtgcttacagtgaagaaaaaagctatgcgacgagaaataaaattattaactgaagaaaatcaacaattacgtcgatataccttactagcatcaatcggaattttattaagtatgatgattgggttagttcgaatggttcaaaaaaattagttaggaaattttttagagggaagtatagtggagttaggataccgaaaagcgacacttgaagatttaccaaaaattgttgaaatttataaccaaattattccgtcaaggttagcgactgcagatcttactccgataacggttgagaaacggaaagagtggtttgaagcgtttgacgaaaattatccaatctgggtaattgaatatcaaaaagaggttctcgggtgggttgcccttgagcacttttatggtcgtccagcctatgatcatactagtgaaattgccatttaccttgatcaacggttacggaaacaaggggttggtacaaaaaccatggaatttattatcggtcaattgcctaaattaacagttgatacaatcgtggcttatatctttggtcataatattccaagcctaaagttatttaaatcgtttggttttacgcaatgggggcttttaccacaagtagcagagcttgatgggattaaacgtgatttagttattttaggacgtcattttaaatgattattgtgtaaatatgacataagtaaagccacgtccataagaagtaaccagaataggcctccaacgcccggtaaagccgaatgctggaggcctatggtgcatatgagagcttcgtattgaaaacgaaggtgcccgtgatgctttgctcgttcccttattttgtatctttttttacttcttcttttgttttaacatcattgatatgtagctcaaacttaactaaatttaaaccagtcatcttatcgattgcacgctgcacctcagaacaaacagccttaaaaatttctggagcacttttaccatattcgatggtagcttccatttttaatgcgacttgcttttcaccaacatcagcatcgattccctttgttggattgcttccggaagttactttatctgctaattcactaaacatatttccgtcgagggaaaggatcccagggactttgctagcggtaattccagcaattttttcaattacctgatcatcaaatgttaattgttcatcaattgttttattatttgtagtggttgtcatattaattcctccttgaattagttggcaaatttatctaacatttttatcgcgagtttatttaatgaatagccttttgcatcaagaacatagccaattccgcctaagatagtgacagctaacagaatgccaatcattgggaaaaagccccacataatccaactaatgctgataagcagtcctaagataacgccaattgtagcaagtttcatagtgtacctcctttttagacaatgttaactgattctttgtttgagtatggacttaacttaatatgtaatttattaagatcaatgtcgaagtctcgtttaaggttttctttaattgtctggagtagtactgtatgaattagttttggattggttctattggacatcattccgtgaatggtaacatctgcattatgattgttacggtgcattttgagtttaattactgggttataaaggtcaaatttagcaattgaagtagttaagctatgttcaactgcatgttgatcaatttgaactttattagcaccatccttagcgattgtcatttgtttagtcgttgttgggcgaaaaacggcaattgctattacggttaaagcaacgataattaaaaatactgcgactccggctgagaaactttgaccgatggggctgtgaagccaatcgttaactggaatcgtccaagtttggtcacgataaaaccataatgatacgacaacgattccaataattacctgaagcatcatcacaaatgaaacccaccattttttccatgcggccattagtaccacttcctttctataaatgtttttttgctatgaattaataataacataagagaaagcgttttacgttgattacaaaaatgctaaaggtaatattaagaacctattaacagaatagtcataattaaaaatcgatcttacaatcatgttccgatgtaagatcgatttttaattctttaattattttggcgctcttgtagtttggcaatttcagaataagcaggggcaagcatatcttcaatttgttggaagagtggagtataacgttgatatacttttactgcggttggatctggttggtaagaactgaccttaccaatgaacttttgtggtgtatcaagactatcgatcattcccaaactttgcatagccataactactgatccaaggcagcctgattcaaatgagtctggaacattaacaggacagtttaagatatcggcaagcatttgacgccatacttttgaacgggcaaagccacctgttgcggtaacgcttgctggttcgccaactaaagcccgtactgcttggaagactgttgcaatattcatgctaattccttccatgactgcccgtagcatatcagcccgtgtatgaatatgagaaaggccaaagaaactaccgcgcgctttggcattccacaatggcgcccgttcaccgcccaggaagggatggaagagaagtccatgtgcccctgctggtactccttcaataacgtgatttgctaaagtataaggatccacctgttcgttcttaacagcgctactatcgacaaggtgttttactgcccattcatagacatcgccaccgttattaagcgggccaccaacgacccacaatcctttattaatagcatagcagaagaggcgtcgttctggatcaataacaggatggtcagttacgactcgtacagctgcagaagtgccaattgtaattgctactgtgttttgcttggttgcaccaacaccaatatttgaaagggcaccatcataagcaccatagacaaatggcgtatcagcgggtactcctagtttttcttgggcttcgggcactaaaccagttgcttgagttgttccatcaacaatttcaggcagttgatctttggttatccctgcaacccggagtgcctggtcatcccaatcacaagtttttagattcatcaagccagttgaggaagcgattgacatatcaaccttaaattcattaaataaccgatagagaaggtaagctttaatatcagcaaaatatgctgtacggctaaataaatctggttcgtcttcccttaaccaaaggagctttgtcaacgttgacatgggatgaacaggaacccctgtcttcatatataattgttgtccttcagtcatcatcttgaggttatctgccgcgcgctgagctcgactatcagcccaggtgattaaccgtgaaaggggcttcttattcttatctaataagaggaggctttggtttgcacttgagattgaaactgctagtagtttccctgtactgagatcagctgccgtagccacatcatggatagcttgttcagcagcattgattacttcttctggctcttgttctgccattcccgcggcattgcggtgcaactcgtagccatagttagcttgtgtgatcacctgtgcatcttgatcgtataaaacggcctttgtgctagaggttccaacgtcaacaccaattaagtagttcatttattgttctcctttaaaactcaatttaattctctttgtaatattatatgctaaagtgactggtgtgcaatgatttcaactggtaaaagggtagtggaactgatcgtgctttgttggttaatttgcgttaaaagtttattagctgctaagctacccattagctccatatcttgcttcaacagaaaaattccattagcgacatattgcgaccattcccaatcatcaaagctaactaagccaagatcttcagggaaagaaaggtttaattccttaaaaattgctaaaaggtcaaataaaatgggtcccattaatgaaacgacagcagttttgcctttaagctcatttaactgttgcagaaacgttttagcaagccactgccgatcatgtcctcgggtttcaatattgtgatagcttagcccgttatcagcagcagcgacctttaaaccggcaattcgaggaatctgaccagatgcctccgcaaagtgtgcgctgacagttaaaatattctgataaccattttgatacagaatcttaccgaggttataacaagcatcacgattagcagaagtgaccttgccaactgtagaaggctggtcatcaacttcacggtcgacaattacgaggggaatgtcgttatgaatagcaggggcgaattgactaaagtgacgggaattaggctggacaataattccgtcaactcgttgttggtatagtcgctgaagagcacgactttcattttcccgtgagttgttcgtattcatgaggaggatatcatagcccgcttgttgcaaaacatcatcgattcctttggcaagtaaagatgaaaaggggttagaaatatctccaacgaggattccgacaacgtgactatgagtttgtcgaagctgtcgtgcggaagcggttggaacaaagtgaaggtctttaattgctttttccacccgtttccgcgttgctgggcgcattttatcataacgaccattgataatacgtgaaacggtagtcactgaaacaccagctgctttagcaacgtcagcgatagtagtatgttgcgtcatttgtttattcatcatccttattagttctactattaagaataccaaaccatacaaaaagcgtcactagctaattcgctaggacgcttaaattgacttagacaaataatgaaatggcgtagacggctcctaacccagcaagggctaagacggaagtaagagttgtccacgaaagtaaagtttcctttaatgaaaggccaaagtattccttaatcatccagaaaccggcatcattaacgtgtccacaaaagacagaaccggcaccgatggaaagaaccattaatgttgccataattgagttactaccaaattggtgagccattggaacaacaagcccggcagcagtcatcgcagcaaccgttgaggatccgagtgacatccgtaataaagcagtaattaaccaagcagctagaattggtgaaatgctagtttgagcaaatagtccagaaatgtacttagaaattccaccatcaacaagaacttgcttgaaggcaccaccaccaccgatgatcaaaagcataactgagatttgcttaattgagtcggcaagggatgtcgaaatatcttccattttttggtttcgttgtagacccatcgtaaagattgcaaaaattaatgaaagaagcattgcaaggtcaggagcaccaataaattggatgaattcattaacgggattgttcttagggaaaataaatgaacaaatagtagcgacggcgattaagataactggcatcattgcagttaaaacggagataccgaatttaggcgtctcttcaagcttgaattctttatattcgccaagaactgaaatatcaatatttttacggtagacacgcggatatactttttgtaatacccagttataaacaggaccagcaataatgattgttgggatcgcggctaaaataccaagcagcaatacgtgtccaaggttagcgccaagaatgtctgtaatagcggttggagcggggtgtggtggtaagaaagcgtgggtaacgtttaaggtagccgccattggaataccgaggtacatcaatggcatatcgagttcccgggcaatgataaagataattggtaaaacaacgacaagcccaacttcaaagaataatgctaacccaatgataaaggaggcaaggataacagcaacttggatccaacgccgaccaaacttattaatcagggttgttgcaatccgatagccaccaccagcatcagaaactaatttcccaagcattgaaccgaaaccgaagatgatagctaagtgtccaagctggcccccgatcccagtttcaattggaaatacctaatatacgaaaaaaggcgtaaagcgcctaaaaaattaaatattccagtggatcttaattttattatcgttccatacgtctatttttttaattaacttttttacgataaatttctgcttatcatagtcgagactatcaatgtcctttatttgagctaatatttcgttaaaagctacaattttatcgtcatcatttggctcttcaagcggtgcgagttgtttttttagcgtttcttcttgaagctttaaatcagcgcttttcttactgatattatcaatattgacatcatcagaaataacgtagaggtcaatcaacctttgttgctgttttctgactttcgctaattctttttgaattgcttccacatcaatatcaggtttcttcttaaccggtttctgtattgattgaggattcaacgctaaattcttaatttcatttatcacagcaggctctaagtctttagcatatacgagcttgaaaggacaattaggatccattattttatacgtccttgtcttttgctttgatttgtatgtgctaggacagttataacgaagtttgcgtttaccgttatatacgtaagagttaacgaagagagtagcaccacaatagccacaacgtagtaatcctgatagcatgtattttgattggaagggtctaagcttcatattgaaacgtttataggtggccgtttggcgttcttttaattcattctgtgtcttgttgaacgtttcctcgtcaataattggagaaaatttaccatcatatgtttttccatcatatcttattttgccaaggtaggttggattgctaagaatataccttattctagtatcagaccagttctttttatttccgatatgtccttctaagttaagtgtttcttttatcttattaattgacgtgccactaagatacatcttgtaaattcgtttcactatttcagctcttaacgggtctactttataattgtcgccatcaacttcataaccaaatgcaggattattgaattccataatcttaccagacttagcacgaccaactcttcccattgacatgcgctctttgatttgctcacgttctaattgagcgaacacacttagtattccgatcattgccttaccaaatgcggttgaagtatcgaaattctctgataagctaatgaaatggatattattcttttggaagacatcttcgataaggtaaagagtgtccttttgacttcggctcaatctgtcaagtttatagacaagcacagcatcgtataatcctgtatctgcatctttgataagctgttgcatgctggggcgattgatatttgatccggagcgaccaggatctacgtactctttaacaatcgtccaatctttaatttcacaatattttttaagtttatctttttgttcattaattgagtaaccttcttctgcttgttctagtgtcgatacctgacacggacataaagtgctactttcatgtccctaatcacgtcctttcgtacatgtgttctttatggtgtctttttaaaccggtcgaattcgaccggtttaaaaattgagctaattcattttaataatcatagttgatataataatcaaaaaaggtggtgattgttttgaaattgtttaagctatttaatacattaaaaaaagaacatgatcttttaaaaaaacaagttcataataatcagtccatcattgagaacaggcaaagtaaatttcataatgattttctacaaaaaaagaaagattttgaaaataaaaattaattaaaaatatagtgcaattggctttacgaaactatcgccatttttaaggagtccagaagaaaagaaggtcatttcagataatgcaggcacgatattgccgaattttgacaaatcttgaatatcattgttggcccctaaaacattagaaaaaattgactctatacttacatcttctgttttagcttcaacaattcccaatacggttatagggcgagaagaataagcaatagattgtaattctccattgttcattctgaagtgatcattatttgctaaaatagttgctccatccatatgaattaaaatattcccttgagtcattagatttccaaaactcataaagtgtgccattaacttaaaattgctttccaattctttgctccatccatcggtagcttgcatcatattttttaaattagaattgagtccatttccacgatctgagctcaaaacttcacttgagaatttaaaatcaattaatgagaacggggaagtggttaaaacaaaatctccttcgctagcagtacctaattctttaatcaactgcttctcatttagaagattaatcaaattatttaaattgtaatcgtttagtaccacattaagatctttaccaaaactttccgaatcttcactagcagctgtatgtgtatcagctcctttatattcgcccttaataatagacggaataccaccgctaatgccagaagtattactactagtatccgaagttccacttttgctatcattacttgatttgttaactattgaatcaatatatcctttgtttaactgcgcgagagcagaatataattcagttttattaagaaaaattatttctttatatttatcatccatagtttcagtatttcctttctttatggcacttgaccattagcaattcgttctgctgcttggttcatcttgatatttgtttcgtattgagtatcaggatcaccacaataagaccctgcatcgttccattgcgtcatcttgtgaccatcagttgtgtaagatgtgtattctttgaaattagcaggaacgtcatcagggcgctgatcttgtgaaggcgtcgcttgttgctgtggctgtgcaggagattggcgttgagtattattttgtgctgtgctagcatgttgtgtgctacttacttgagtagaagattgttgattgcttgaattactatttgcattagaagaagtagagctttgattatcattgctttgcttcttctttttattttgcctgtgtttcttgcttagttgcttctttaaagaagaattttcagcttttaggctactatcattagaagtctttgtgctttttgattgctgattactacaagctgctaagctaacacccgctagcaatgtggcacatattaaacctatctttttcataaaatcctccaaattatttcttgaattgctttccacagtccatacatacaaaatcagtttgatttgtatttttacctagaaagccagcgacagcaccaatcccaccggttaatacagcgccgccgatagctttcccggcagagaagttcttatgatgttgtcctaatggttgaacgttgctactaccgcaataagggcagaataatcttccggtgttttctcgattaatagcttctagtattgcagtgcttgtcatctgattaatttctcttttaaggtcagcaggaacaaagtgcttacgagctttatcagtatcgaaaagtttattaacgtcttgataacagataaatttatggtcttgggtaaatcctttatcatcaagaaatccgatcttatttttgcatacaaagcatttcattaatctatttctcccccgtatagcttttaacgtcgatcacgcttggacgtatattaataatttaagataacttctttaacaatattttcatcgcgcgacgggatatcgttttggcgcataaactcaagataattcaccgagtgtggatcatcgccagtgacgtcaatgtaattagagaaaaggtatttaatcataaatttgttagcgccatattccattttcatcttcatagaaattgttacatcataaagttctttttcgtcacgttgcttagcaagatgacctaattcatgaattaaaactgttttttgctgagtttcagttaatttagtatctatgtatataactgctttcccttctaaaataggtggaaaagcaatgcgtcccgggcaatcaaggcttccatacattactacggcattcaattcttcgagaagttctttcaacttattatccataaagcagggcgaccttttactctttatttctgagataactttctagtaaatctttcattactttcttatcatgttcagtaacgggttggccttcgaatgacataattgttccgagagcttcatcaacagtcgcattatgtacttgatctgctttactcttgcgccctaataaataatcagtagaaacatcgaaataatcagctattttatttaagactttagggctaggctttcttttattcgtttcgtacattcctaaagtgcttgttccaattcctaatacttttgctaattggaattgtgacatatgattatttgtccttaaatcggctattctattacctatggacatatccttcaccttcttataattactaactgtgataatcatatcactatttgtgatgaaagaaatatcaaaatagtcactaaaagtggttgacttatcactattagtgatatattataatagccgtaagataaatcactcttagtgataaggaggcgatgtgatgagcgtcacacctaacaaagtcttaattgatttgagacatgaaaaaggtgaatctcaggctcaagcagctaagaatattggtatttcacaatcaatgctcgctatgcttgaagctggttatcgtaaaggcagcgatgacactaaaatcaagattgctaactactacgataagtcagtggacactattttttttgcagttaattgtcactcttagtgataaggaggtaatcaaatgcaacaactatttaattttaacggacagcaagtccgcacagtaactattaacaatgaaccttactttgtaggtaaggatgtggcaacgattcttggatataagaagcctgaaaatgccattgccaatcatgtagagaacgaggataaaaccactaccctgattcaggggactggttctaattacaaatccaagtcagtaattatcaatgaatccggcttgtactcattaattcttagtagcaagttaccaaccgctaaagaattcaagcactgggtaacaagtgaagttctaccagctattcgtaaacatggtgcctatatgacaccacaaacaatcgaaaaggctctccttaatccagatacaattatcaatcttgctactcagttgaaaaaggaacaagagcaacgtaagcaacttcaagcagagaacgaacagatgaaacctaaggctttatttgcggatgcggtttctacaagcaactcaagcattctaattggacagcttgccaaaatccttcgccaaaacggagtaaatattgggcaaaatagactgtttgcttggatgagaaagaatggctacttgggaacaagaggaagtaatcgtaatgttcctactcagcgttcgatggagttaggactattcaaaactaaagaaacagtaattaatcattctgacgggcatacaactgtcaacattacaacgaaagtaactggcaaaggacaacaatatttcattaacaagttcttaaatgcaccagtaattgaagcttagggggtgatcagatggagataatcaacgtagacaaggacgggaacgttattcctgacctttcaaagaaaacaattcccaaggatttaagcgatgtaatcgttgaaatgatctatgaagcacgttctaaggaggtgatttgatgttaggactagcaattccttgggtggtaattatggtttgcttcttaattggagcaatcgtcaacgttatcgagggcgagaagctgaatgtgctgaaagaaaagtacagaaagaaacattaggaggtaaagaaaaatgaaagacggaatggaacgaattaatcaactgcttgatgagtatgatttcccattaaatgccatacaaatggtacgggaacgcttaggcgattggttcatcagtggcggtaagccgactgatggctatgtttggcaacaagcacgctatcttgaaaatctaattcgctacggactagctgaacgaaaggcggtgattgaatgagcaagctgagcgattttttgttaaagcgacgtcatgaattgcgaatgactcaagttgagttagcgcaatggttcaatcttactgacagagcaatagcaaattatgagaaaggaaggcgtgaacctagcttagaaattatgttgaagtactcacgtgtctatcacgtaagtatttacaaacttgtggacttacgaattgaagatattaaaggaggtgaaacaaatgacattaacaaaaatagttaattctaagctcttagcaatgctaatgggcgcttggatagcttattgcgcaggcgttggtgattatggcggagcggtattcctgctgttcttctattcgctgatgctgtgggatttgaacgcaaaaaaagccaccggatccgacgcatccgatggcaatagaaaacaaaataaatatatttaggagttcattataccatgtttgacgaaaaattgaaaaaagcagagggatttatccttctacaaaataatctaatgaacgcagtatttgttaagcaagcaacccccgtaggtgatgttgaagcacttactcgctattacgaatcgcaacaaactttatcaaaactatttaataagcaaatggggtggatgtaatgaacctatctgaaatctttgcccgtaatttgcgagttcgtatggcaacgctcagtttcaaaacaagtgacttgtacaagatgacaggaatatcaaagacaaccataatggctctggaatatgggaaaaataagggagttatgtttgaaactatcgacaaattagcagtagcacttgaatgcaaaccagaagattttttcaaactaaattgcgaatggactagtaaatcacacacaaacaactggaagaatgaggtggtcaagtatgactaatcaagtagcacaacagcagaaaccgactaagctaaccgatcttgtattagatcgtgttaaacaaatgcaagacacgcaggacttgtcactacccaagaattacaacgcttctaatgcgttgaatgcagcctttctcgaattacaaaaagtacaagaccgtaatcatcggccagccttagaagtatgttctcatgactcgattgttaagtccttgttagatatgacactgcaagggctatccccagcaaaagatcaatgctacttcatcgtatacggcaatgagcttcaaatgcaacggagctatttcggtactgttgcagcagttaagcgactggatggtgttaagaaagttagggcagaagttgttcacgaaaaagatgactttgaaattggtgctaatgaagacatggagctagtcgttaagaggttcgttcctaagtttgaaaatcaagataatcaaattattggagcttttgccatgattaagactgatgaaggtactgactttactgttatgactaagaaagagattgatcagtcatgggcacaaacacgtcaaaaaaataacaaagtacagcagaattttagccaagaaatggcaaagcgtactgtgcttaatcgtgccgctaagatgtttattaacacgtctgatgatagtgaccttttaactggtgctatcaacgatacaacaagcaacgaatacgatgatgagcgtcgagatgtaacgcccgttgaggatgaaaaacaaagtactgataaattgctagaaggatttcaaaagtcacaagaagcgaaggctaagggggtaagtaatgatggcaacagcaacgaaggcaaagaaaccagtgaagaagtcgcagacggacaaacagaactcttcagcgaagggacaatcaaaccagccgatgaagctgacagctaataattactatagccatgagaccgattggcaatacatgagcgtgtcactgtttaaggattttgaaaaatgtgaagctcgtgccttagctaagctcaaagaggattggcaacctgtatctagccctgtaccgcttcttgttggtaactacgttcactcatactttgagagtgcaaaaagccatcaagactttattgaagctaacaaaaaagagttaatgacccgacctactaaaactaatcctaacggacaccttagagctgaatttaagggtgctaatagcatgattcaaacgttgcaagccgatgatatgttcaattacttctacgctccaggcgacaaggaagtaatcgtaacaggtgagattgacggctacttgtggaaaggcaagattgacagccttgtgcttgataaaggctacttctgtgatttgaagaccgttgacgacatccacaagggtcactggaacacttatgaacatagatatgtgccatttattcaagaccgagaatatgacctacagatggccgtttatcgtgaattaatcaagcagacctttggtaaaaagtgccagccacttatctttgcgatcagcaagcaaacgcctcctgacaaaatggcaattgattttaacggcgttgatgatgattaccaaatgcaagccgatttagacaaagtgaaagaactacaaccgcatttttggaaagtgatgactggagaagaagaacctgttcattgtggcaaatgtgattattgccgtgaaacgaagatgttaagcggatttatacatgcaagtgaaatcgaggtatagaaacatggcacgcgttaaaaaaattaagattaaaggcttcacgatcattgataatgacataatcaatgatccaagaatgcaccttaaagccttaggactctttgcgtatatgtggagtaagccagatgattggcaattctatatcagtgagattgctacacattttaaagatggtgaatcagctgtaagcagtgcgatgaaagagttaatggaacttggctatttgaagcgaactcaaaatcggaaagacggtaaattttcaacgtatgattatgttctccaagaaataccgaaaccagaaaatcacagttcggtgccgaaaggcgatttaccgaaaccagaaaaatcgaaatcggaaaaaccgattccggaaaatcaaggactactaatcactgataacactaatactgatttaaataatactaataaagtgttaagtgatgcacagcattccgtcaaagatgttttcgagctttggcaaaacaactggggatttcctaatggaattgctcaacaagatttaactgagtggacgaataaatatggagctgacttagttcttcatgtaattacgtatgcattaagaagaaatatagcttctaagggcgctgatcgctatttagcaaaaacgtttgaacgatacgatcaacagtcaattaaaacggtggaacaagctaaaaagtctgaacaacaacacgagcaacaaatgagccgtgaatatcagcaaaagagtggctcacgtaaacgtcaaccaattaacgaaccaatgccagagtggttcaaaaagcaacaagaagaacagcctaacaaacaacactacgaaagaattgatgatagtggggatccgatgccacatgactaaagaagaagtgaaaaagaaatgggcttctactcggaagctattagaagtaactgatagtgaatataacggtgtaacacaagaagctgctaacctgcgttttatcaaaactaagctacaaatagcagtttattatctgcaaatgcttgatgagcataattgcgagtatcaagtaccttggaataaagaacaatttaaatggctacttagaaagcctgtcggggataaaaagaaacaacaggctaaagaatggtgccatcagtgttgtttaatacgtgacaaagcctgcaccaattggaattacaaggaggcaaagacagcatgaaaaacaatagcttaattaagcagattaatgatttaatttttgctccagaagaggagattgcatggattgggtcagcagatggcaagcttgcaatgaattgggaagaatttagttttcatttttctcagctcaatcatgatccagaagacgccaaacaagagttagcagttgatcttgtaatcgtaatgaaagatcactcttggtacgaacgaaatttaaatgacgggggctggattcataagcgtatgccctacttagctataaatcaccagccttttaaatacgtttcagaagccgatagcccaaatggctcatggccctggagtacgttagaagaactaaatgactgtgaggaggtagcgcaatgagcacagaagtaaaagtattatcaacaagcacaagaactaacttagaagcattgaaaatgttagcggagaagaaaaatgataacgattgatttagataataagtttgccatcgtcagtgacggcgaagcgctcaacattgttcagaaagatggcaaaatgcgaaagaacggtactccatcgggacaaaagtggtggttcaacacgtatggccaagctatcaagttctacgaaaagaaagttgacgctggaagacctattcattcattgcgagaactagccaagcaaatagacagcggatataagcgtattgaaatcatggtagatcaaaaactgaaagaggcggggattgaatgagcaagcgtactcgtaagcgacaaatcatgaaagcaaaattaatgagcctgccgccttatcaaagaaagcgatacaaagcactaaacataattgctaatgcgatttgttcctgtggaatatcgataaatgagctatcaaaatcaaagaaacaccatagtgtgacgaatcgaaagaggtggaagtaatgaagcaattaccgttatgtgtggggattgtctgtgtaacggcaattattatcacaataattatctgcaaggttagccttgaaacaatatttagtctgattattggattgatgattattgcttttgtagttgccaacttaattgatttataaggcggtatgaagagcaagacgaaatggagtgtgtttataaagaatgataaagctgtatagagttaacgctttttttgatagctatattgttaaggctgctaatgaggaaagagctaaagaactagcttggtttaatgagatggaagtaatatctgaatcgtggatagatgaatatgatgttcaagaactagacattaagaatatgaacgttgaagaggtcatatctggaggcaactaatgaaattaactgaaaagcaaaagaattgcccgtattgccatcacaaaaagaatattgtcaacataccgggattgtgtgtctcaatagatcctaaggtctctaatggcaacttaactatcaaatatgatgcatcgaacaaagacatgacagataacaatattgtcattggagatgacgatggctatgtgtttggcggctggaatttaactattaattgttgccctatgtgtggtcgaccactgaacgaggaggaaaaataatgacaaaagaagaaatattcaatgattttatcaaaaaagtaaaatgggacaacttccaaattattaatgtatgcagaagcaacagagacaatgttcaatcatttagttttgaaattactgataaacaaactgccactaacattgaattagctaataaactttcaaaagagaatgcggaagttgcaggcagaatgaatcgactagatgagttcatgcacacagacgagtacaaccgattaagcgataaagagcagcgcttaatgattattcagtacaacgctatgcaagtgtatgctgatgtacttttgcaacggattgatgagattaaggagcgtttgtaatgcacttttatctagttgatgatgacaactcatctaaagtcattgttgctcattcaaaggatgaagcttggcgtgctgcttctaagcgtgattttggagatcctgttgatccagaagcattctatgaaattactatgttggcgccaaatcactataagaaggcgcaaattattgtggaagaaaggtgatcgcttaatgctacacaaatataaaaagatagttccaattaaggctgaacagttcgatgggtcagatgaaatgatgaagaaatattgtattaccgatgatggctttggtgaaacctttacttttcggaaagataataattgtttaccgctaaaacgtggttggtggattgttaatcttgggaagattaccgtatttgattatacattcactgattggaaaacaatgagtgatgaaaaatttcgtaaaacttatgagaggtgcgactaatgattagatatgatggcgaagttgtctactctgagtcagggagtggcattagagcaaacaaccggatgctttttaacgaagcgcaggtatcagcgattaaagcaatcactaatggtgagttcaagcgccaaagtgattttggcacagtttacgttgtcaaagatcaactagtagatgattacggtgttttagagattatcaaagtctttgagcaattagatgatgcgcagaaatatgtgatggctcatccacgagctgcgttgttgccaagaaaggtgatcaagcatggcaaagtcaaagagcaaaagtaaaaaccgccgacgcaagaagcgtcaacggcgagaagaaaataaattaaagcgggaggaaaagaatgattaaggatttattgaaatacattcctctggtatgttttacagcaattattatcacggaaattttatgtggctttgataagcacatgattggatatgcagtctttggattgtttgtcttactaatgtttggagctgtttaatgaaaaaagacgctctactgtgagagcgcccttgagatatatgtataacaaaataattatatcacaaggggagtagggcaagtgaatagcatatttgaaaagtataaacgtgatgaatcgtgcgacatggctcgtgaatggttgtctaaatattggtattggagagatgaagccgaaaaaaagaagattacgctaggatcgcctgattttgacggacagcctaaagcaaagacatatgatcctgaccgtcgtatgatcgattggacaaatgcacaaaacgaatggaggagacgtgaactagttctcaagtacattgcttcaaagggagacgagcatgaattatatgcgcttatactggataatcgctttgttcatcatcatcgctcaataacagaggtaagaatgaaactgaatatctctgagcgtacttttaaccgtatgcagaaagaagcattgtgggaagcagcgaggataattcctactaatgttttagttgaaaagtaaagtggcggtgttttggcggtaaaatggcggtactttggcgtgattttcaagaaaaacagccttattatggtattgtcgaatgattacgaaaacgactttacttttcaaataacgtgcccgagcaagcctttaactgctctacgtattttcaagactcattactatactcacaatagggatctcttgttaagcgtaggaagtgtggaatccggtaaccaagccgacgcgatggtggcagatgaccataatccacgtagggtattagctatggaaacgttgatacccagtaaatcatgatttatgtttaagactggcactcaccttctatatgttttctaatactacagtgatgattgattcttaggtggagtgtttataatacgagtgtgtgcgaatttctcaaaataaaaccttaatagagtgtcagtcctttatgcgaatatgcaaattagatgccaagtatcctggagtagtccaatacttgtgggggcagttcccaatattcgcaattgcagtgctttacgagtcgcactgcttgctgagatccaagatgggcacacaaggtctcgtgtgacaaaagtgtggtttgaatccacctctcggctttatcacggcaaactaaactatgataggagatgaaagctcctctttcgtaattacatagtacttttttgtccaagccgtgatttaatacagagatgcaaagagcaacaaaattcaaaaacgattagtggatgcaagcatttctgtattatgctgataaaaggtagggctgaataccctaatggcacggttcgattccgtccatcagcattcaaggctcatctactttttaaaacaatcaacgaaaggaggaagcacctacttgctatgatgttcttctatatgccttgatgtaaagtctccaatctacgggggctttttttaatatatgaaaggtgataattatgagcaaacatatcacggttaaagaagtaaaagatattgttaattcatttagtgagaatgcagattgggagggaatgcatatggaagaagacgatatgtatgaggatgtgcttagggcgattgctgacggtgatccacattcaaaactgctagcaagagaggctctgaagtcaaagaatgttaaattcactcggtggtattcatgagaacgactaagaattggggctttactaatagtggagccgaattatatatgttagctcatgctgaacgaacgagaaaggagcttgaacgtgagtctactagatcaaatcaaaacacaagcaagtatcaccgacagcgttctagtgtctttcagcatggggaaagatagtattgcagtgatggatttatgcttcaaatactttaagcacgtacaaccattttttatgtatatggtgccagggcttcaatttcaagaagaagcactagcaaagtatgagcatcactacaatacgcatattatccgtgtaccgcattttgagacggcagacttttatcgttatggttccttccgtgatccggattacagcgtgccacgtgtcaaaatacgaggtatctatgcttatttgcgtaagcagaccggcattgcatggatagctggcggtgagaagattaacgactcaattgtccgtagagccatgttaaaacattcagggagtatagacactcaacgaggacgtttttaccctgtaatgtactggacggacaaagaagttaagcactacatcaaaatgaacaagctactgtatccaaagttcaatcgtgaattaggatttagttttcattcattagccggtaaagaactatcagcaatcaaaaagatatacccgcaagactacgagaggatacttaaattcttcccggaagcgcaggcgggtgttttacaatacgaggcttacaagaaaggaggagatgaataatggcacggcaacgagttatgtctgaacagcaataccttaatagcaaaggtgtaggtagtgctgtgagtgattatatgatggataagacagtcgtgcgtaagtctgcataccatcagcgtcaagacgaaagatcacgaaaagccttaaagcagaatcaagatcagtattatgccaagcgtaatcaagctagacgagaatatcggcgtttagtttcaagtggcaaagtaagagcacccactcaagcagaaaaaacgtggaatacggctcatggcttgtctgaaaatagatcagtgcaagcggcccgacgtgttcttgctaagcatggtgttgattggaagacgggtaaacgtattgctccagcaagggggcgtggattgtggcccacttttactcacaagggctcttctggcaagtcaagcggataagaggtgaagttaagtggcaaagcgtaaacaattgcagtcgttcgagtatgggacaatcacccgtgacaaggttaaattagctgattacaatcctcgtatcattgatgagagcaatttaaaagaattaactaaaggattacgtacgtttggcttaatcaagccgctagtaattaacaagcgcactggtaatcttgttgaaggccatcagcgaatagctgcaatggataagatgtatcgcaagaaagattatgaaattccagtagcatacattgatgttgacgagaaagaggaaaagacgctcaacgtccaactcaataatccatcaatgcaaggtagctgggacttgggcgccttagccgacttgaacgctgacgggattaactgggacgatatgggctttaacaaggctgatattgattttatgtacgatggtgaggtcgattttgatggagatgctagtgatgaacttaatggtgttgctgatggtgatagcagcatggatgaacagtcggtggtaagtaagcgcgacactccattcgatgaagaagtcgaagatgagaaagacaagcttgctgatatgtccgaattaaacgacgaggacggtctagaagaatttaataagaaaaaagctgagtttcgtcataaggataacgacaacacgatcattaacttctataccaaagtagtatttcctagcaatgatgcaaagaaggacttctacaagaaagccaacataccagccaatgaagagtacataacctttgaccaagttaaacgatactttgataattaaaagtgaggtgtaatcaatgggacgcaagccgttaattgatgagcatacctccgaaaaaatgcaaagctatttaatggctggtgtgtcacttaaagatgcctgtacgttgctgggtatcggttacaccacatggaatgattatgagcgtaaaaatccagatattcggaggaaaaggaaacaatggcagggcatgcttaaagctagagcaaagatgaatattgctgaacatgtttttgggaacaaaacaaaaggcatcgagccgagtgctgaatggagtagatacttacttgattctattactgcgcaagaaactaagaatgttcagaacgccttgtcgcgcgctaacgctcgtaagattaacgcagaaacaaagcggatcgaagctgaaacgaagcgacttaactcaaacgatgagggtattactaagattgtattcagtgatgacttaaaaccggataaagaggacgatagcaaacagaaaggaagtgaagacgatggagcagacactaagcctaagtaaaattgttggcggtggctattatgacttttggcatgataagcacttttaccgcgttgttaagggctcgcgtgctagcaaaaagagcaaaacaacagcgctcaacatgatttaccggctgatgaaatatccttggtctaacttgcttgttgtacgacgctactcaaacactaatcgacagtcaacctatgcggatctcgtgtgggctatccatcgtttccatgctgagcatcttttcaaatgcaatccatccatgccggagatagtctataagccaacaggtcaacgggttatctttcgtgggcttgataaggcgttaaaacttacttcaatcactgttacgcacgggtatttatcatttgtgtggattgaggaagcttatgaaattgaaaatgctgataaattggaaacgttgcaagagtctattcgtggtcggattgatgttcctggggcctttaagcagattacagtgactttcaatccttggaatgctcaacattggctaaagcggacgttctttgatccggaaacacgtaaagctgacacgttcgcccaaacaaccactttcagatgtaatgagtggctcgatgaacaagataggcaacgctacttggatttgtataagaccaatcctcgacgtgctaaggtggcagcagatggtgactggggagtaagtgagggcttagtctttgaagataacgttgaacgtgttgaatttgacccacaagaaaagctgaccgaatgcgggcacgctggatttgggcttgattacggctttggtggtgacccgaatgcgtttgtagcattggcaattgatccaaagagcaagaatatttggatctacgatgaaatgtatacgtatcaccaaacaacgccacatattgccgactggctcaaaaagaacggctatcagcacgcttcaatttatgctgattctgcttcaccagagcgcacgcaacagcttttagacttggatatagataatattcaatctgttgttaaaacgccaatagaagctggaatagatcaactatggcaatacaaaatccacgttcacccgaaatgcaaaaacatttggaacgagttcaataattatgtgtttgatactgacaatatcggtaacacactcaatcgcccgaaagacgagaacaatcacgcaatggacgcgttgaggtatgcggtacgtcaatatatggatatgtatgatggctcgatgggcgttgattggggtaatcagtatcacatcgctagagaaatggggcttgatatttaatgcaaaacacaattccacaacaacatcgctttgatttggaagctaaccgagaatatcaagttccggttagctattttaatacgatcaaagattatccaatgcaactatacgaaacagcttataagttcattcgtcaccacatcgacagagaagtgccacgattaaaagaacttatgcgctattactatgctgatacgaagattaagaaatgggctgggtcacctaatccagacaatgcgcataatcgggtgtcaacaggctttgcacgctacattaccaatattcgtgtgggttacttcatgggtaacgatattcaatacaagatagcgactgatgatgacagcatgaagtcattatccgcaaggcttgatgacttacttactcattacaacgacaatgcaaacacgccttacattgatgaaatgctgaaaaaagatttatcaatcatgggtcgtgcttatgatcttgtctacgttaacgaaggtgaaacaacgttaaacttagcaaagattgacccgacaacgtgttttgttgtttatgatgattcaatcaaggctaagccgctgtttgctgttcgctactatcagacaggtgttttagatgagttgctacgtgagaattacgagatttacactgattcgatggtctatcgctatcattcagatggcggattgcctgagactaactcaccagttaacagcgttgtgtttgacagtcaagagccgttattctttgaacgggtaccgttgacagaatataagaacaacgaagagcgtttaggcgattgggagcctgagattgatcagatggacgcactagacaaggcgatttccacgatggcaaacttccaagaagattttaacgatgctgctatggtagcaactggtcgctttgctaataagactaagccagtctatgcaaaagataagcaaggtaacgttcagatgggtaaagatggtaagccagttgtattggtaccacctagaccgatcattgatcctaaacatcacatgttttacctagagccttacattgcacgtactggactgagtgaaggacagcgtacagtcgtaactcctacgcttcaatacatcacaaaacaatatgattccgccggctggtctacttacaccaatttcttaatcaatgaaattcataagtataccaacacaccgaacgtcaatgatcctaactttgcttctaacgcgtccggtgtagcaatgagttacaagttatggggaagcgatcaagagcgcaagatacaagaagcactatacaagcgtggtttacgtgctcgtattagtgcttgtattgcttactggaacaaaattaatgctttgcccggtgagaatgatatttctgtgcttgctgatatggtcaagcctaactttgatcctaacttgccaaagaatgacgaggagacagcgcaacttgtacaaaccttatctggcattccgggacttgaaagtatgaagtcattgcgtgagattacgcaacgcattaccggtgtatcacctgatgatgagcaacagcggattgatgatgaagcagaggaagaagccaaaaaaacagacgactacaagaaaggccgaattggtattggtgaagtatttgctactggcgaatctgcacaagttgaacagccaaagggtgataagtaatgacggataaagaatggtttgaccagttagacaagatatttaatccgaatagtcctagtgtgcaagcattacgtgacgctgttgaacgtgcagaacataaacaagaagttacttttgatcattttttcaataacggtttgaagtggaatgataaagcgaacccagcagacgttaaagcggtattcgacgctttacgtgagttacgcaatatagctcatacaccacagcagaaagccgttgtcggtgctttgctgaacaatttaccgtataagactaatcttgacgtagcaaagcttacaagccgaattaacattgccatgcttgggcttgacgttgctaagaagctgcaagctgagcaaacagaaattgttaataaggtgactgaattaactggtaaacaacacggcggatataatacccaactgagacgccgtgccttgctccgtgtcgccacacaaacgggtaatgatacagatacattgccactcatctttaagcacgcacaacgcctctcaatggatttagataaggtgattgattttcaagttaaaaatcacatgaaccccaattcattaaaaaaggcagctaaagaagcgctagaaggtgacaagcagtggaattataactctgataaatggcggtcaacggtgcagaaacgttacatgcacacgaaagcaaatcttgagcgaatatttgttactgaggcaaaagtaagccagatgaaagtaaccgcaaaaagcctgaaaaacaacggctacaagtacgttaaagtggtgagccgtcacagtaccaacgtttgtaagtattgtgagggaatggacgggacaaaagttaagatcgacagcattgtagtcggtatcaacgtaccaccattccacccacgttgtgcatgtaacatcattcctactgaaacaccagttaaggaagcgctagaggacttaggattgtgaggttgactatatggataatgaaacttttattaaaatggcaaaacaacgtttgttcgcagaactacatccaaatcggcaaatgtcacgcccaaacgaagcgggtatgtatgtttcttggctgtgtaaaattggcaaaaacaacaaatgtgtaattggaatcattgggagcgatgattattacgagattagttatttcagtgacgaaggagtttttgtgatggatcattactcgttgaaaaagcataaatacatttagcgactattcaaacggatagccgtttttattatgccttcaaacgtgctgacaggcgttaaagagcggacgggtttcctcgacggaggttaaacggaattcatcgacggatgtaaaacggaggtattgataatggaaaacgaaaatgaagttcaaactcaacagcctgtacaagaacaggataatcagccaactcaaaacgaggggcaagaagagaagcctaaagtagagttcacacctgaacaacaaaaagctattagtgctttgcttgattccaagattgctaaggaacgaatcaaagcagatcaagaaaagcaagatgccatcgataaggctattgcacgtactaagatgtctgctgaagagcgagctaaagcggaacaaaaagaccgtgaagacgagttcaatcgcaagcaacaagacttagatcgtcaattacgggaagtaaaaactaagtcaacgttgatcgataagggtattactactgatctactaccgctcgttatgggtgctgatgatgatgaaacttcacaacgtttggatttattagatcgatacgttcaaaagaaggtacaagaagccactgaaaagcttatgagaggtaaacaaaatccaatcaatggcaacagtggctctaacgtttctcttagtgataatccttggtctgcacaatcattcaatatcactaagcaacaagaaatttttaatcaagatccagaaaaagcccggcaaatgattgcacaagcacaacccaagcagggcttttatgttggaaaaataaattaaggagtgaatagtaaatggctgatattcaacaagctacacaattagcaaatatgcaaattcccgaaggttgggccgcctaccaagctcaacagtcggtggaacaagaccaattctttcaatctggtgtaattcaagcggtacctagtattgcttctgcttttactggcggtggtaagttggtaaacattccaatgttcaagcctcttgaagacgtagcaccacaaaacattgatgataccaaggacattgcgctcaatacaattggtactcaattagcacaagcccggctttatggtttcttacaagcttggagtgctactgacctttccggcgaattatctggaactgatccacttggcaacattggtacttctgttcaaacttactggcgtcatattaacgaaaagattcttttgggcactatggatggtgtttatgcttcagatagcatgaaagacaagaatcaatttaatgctgctgataatcggcgaagtgataacacattctcacttaaaaactttaatgaagcacgtttccaattaggtgatcgttaccgtgatcttgcaactgttgtagttcactcaaatatcttgaaagaattacaaaatgctaacatcactgatccaaagactggtaacactatcttaatcaacggtaatcaattaccaactcaaatttcagctccaaaccctggtgactctattaagggtgtacgagtaatcgttgatgacacaatgcctgtaaaagatggtgtatatactagctacttatttgcttctggtgcatttggctggtctgaattgccaactccacgtgctgccgaaacaggtcgtgacgcattacgtttccaaggtgttgattatcttattagtcgtcgtcgctttgtattggctccacaaggtatgagctggaatgaatcagcatttgcagcagataatcctaataagccattccctggtatggaagatttagcaaatggtaaatactggaaccgagtatttgatcctaagattatgccttacgttaagttcacaaccactgacgaagcaattaagcaaggtacaacgacaccaacagcgcctactaagtaatgaggtgattgaatggctgaactagacgcaacgaacgatattcagcgtatgcaaactttattaggaatcgatttagacgatgccgataaaggacgtgttgaagcttatatcgtgcaggctaagcaagccattatggtttatatccgcaagtatcttgacgacaataatttccctactgagttaaattacttagtcgatcagttaacgttagcaaagtacaacaagtttcacaacgagggtatgaatagcatttcagaagaagggctatcaatgacctttaactctaatgacttaaaagactatttacctgacattgaagcttggattgattcaactggtaagggtgatttaactggaaatgcaatcgggtggttctaatgcgatacgatcagacggtttatttgattactgagacagccaacgatggtgatgacctcaactttgagggcacgacaaccgctaaaaaggtcaaggctaacgttaagcgaacgaacctaacactaggaaatggtgaaatgtacgatgccactatcgttcgagtatttggcgaatgtgaagcagatgagattggctttgctgattatgaccaaaacagtggcagaggtgccaggaagattcagaaagtcggacggcacttcaatcgcactgatttctacatcgtcaacagcgaggtgatcttcaatgccaaatgatagctacgagaacttaccacgtgttaatttctctgttaatactagcgattttgaacgtgcaagagccgtcgctcaaaacttagcaagaatgggaatgcctgaggcaatggacgagttcaatcgtgaatacgctagggcaaaggctgctagtaaaatctttatccgcaatgcggctgctgaagaagtagacgaagcgcaaaagattgaaagtcaaaaggtaggtcacagcaaaagcggttatgtgcctactgggacgctacaaggcagtatcacgccccaatttagcgaagatggtatgaaagttagcgtcgtgccccttgcaactgctgaggacgctgaaaaagcccgtaagcagatcagtcaaggagtgaagaaaatacgcaaagttaataagccgtcaaagaatgaagacgcttattactatggtactgcggtggaatttggcaaagggagaaatcctaaagagccatttatgaaaccaagtggcgaaaaggtagccgctcatcttgataagaagtttgaagatacaatgcgacaagcattagagtaggaggcaatatgggcccagaagcagacctaattgtgcaggtcaaaaaggctcttcatcaggtaagagcccccgtttattacgacgggcaaaagcacgatgctgaatatccacaagtgattattgatttaagcaatattcaaaatgagcctcgctcctataaagggattgaggaaactaaactcaccatttctgtggatgtttacagcaaaatagaaaggcttgacatactgctagatattagcaatcaagtcagaaacattatgcaacaagtacgatgcgcacactggcgatcagaatttgacgattacagcgtgcgtattttagttgatgagtcataccaaggagagtcgcttaaaagagcggcttttttgtttgacttcattacttacggaatagcaatcaagaaaggaaatgattaaaaatggcaggatttacagcgagtgacgctaatatcgatccaaattctatgagcttggcggacaaaattgtctacggatgtatgttcgagtgggataagccagaagataagattcaccttctaggacttcaggcagctacttcaactactgataacttggcatcacaagcagttaacttaaaaggcggttcaatgcatgctccaggtgctacaactgaaacctttgttgttgatagctactggcgcaagattgataactacattcaacgcagtttacggcgctgtgttcatgaaaaagtacgtttagggatttttcgtttcgactttaatcgaatgaggaaagaccctaaagatccaactaaatttattgttcccggtttgtttggaaaggcatatccaaacggggtgccacaaacagaagcggttaataacttgcttcactcaaacatcacttacaacatcgatggtgaaacacaagaaggtgtgactggtcaagatgaaatggaaccagcactttatcagattggattaaaactctacacatacgctcataataccgatatgggtggcactatggaccctatcgctgatccaatggacgtttattcacaaaacaacggtggttcaacaacaccagcacaacctaagtaatttcaggaggaattaaatcatgcaagcattaacagttcaagtaaacccacaagcacaacccgcagtattcactccaaagctaaactatggcttttatttacaaacacgagacgataaatcattagcaaagaacggccaagacggtttttcagcattagtgaacggtttgcttgatgagaacgtcgatatgattatcgctgcttatcatcattcttttgcatggtacaatcgttctcaaccatcagcaacagccgttgaagaagcacttgaaacggcgatgtttaacgatgagaaggctaccgatgaagcttttgacgatattcttaagtcattgcaagctaatgattttttagcccggaagttaaacgagtttatcaagaacaacgacaagctaacagctacaatgaagaaacatatcgaatccatgacggacgaagacaagaaagatcaaatggagattggtatgacccaaatcgacgattcaacaacgaagcttcaacagttgatgaccccacaagaatcatcgccgaagcaagacgaatcggactcacacctgttgaactaaaagaattaacaccgaaggagtttaaagcagtccagcgaggctaccaactccatttagttgatcaaagagacttaactttattcgctaaaacggtgccacaacagactgttccgtttgagcctcaacaatcaatagccgacttgattaagcagttgcaagagcgtaatcaagctatcggtaaggatattgctgagggacgagatgaacagccacaggttccgaagaaaactatcgcaagtcaattgctaatggaaatgctgggaggagggtagttcatgagtagtccagttgttgcaaaagagtttctttggaaattccgtgatgaaattacacaaggcgtcgctaaagcccgtcaagctatgcaagaagcagtttccgtagctaaagaagcaggtatgaaagtatctgatactggcgaagattggaaaaagatgggtaacgatgctgaaaactctgctcgtaaagcctcccaagcagttaaagaatcagcaaatgcttctcgtgaaagtattgagaaagttagggtgctaacagaaaagcttaatgacacagttgcccggattccgacttcaaaatctttcaacttaaaagcaaaatttgatgataataagctaaaaactttctctaggaaaattcacgatattcctaaacagaaatccttatggttgaggataaaagacggcttttctaattatctgaaaaacgctcaacaagatgctgacaatacgaaaaagtcattctctaatctaagagaagtaatgactggtactttcttaggaaatgctgttcttaacggtattcatggaattagtaatggattaaaaggtctcattgctactgggtatcaatatacccgacaacagcaaacaatgatcgctagttggaatacgttaactgggtctgcttctaaaggtcaagaaatggtcgacatgaccaacaaacttgctatttcagctcagaactcaactgaaatggttaatgacttaaatcaaaagttttacgctgtcacgaatagtgctggtaagactaaagacttatcgcaagctgtcttaaccttgcaagatgcgtttaatcaaagcgatgcttctattgagaatttctcaactcaatgggcacaaatggtcggtaacggtaaagcaagtgcgcaagatatgttatcaattcagaacgtatttccaaagttccggcaagaattgttagcttatgaacgtgatgcaacccataacaaaaacctaaccatgcagcagatgaacgacatgatgagtcaaggaaaaattagttctaaggctatgaatgatgttctgattggcatgggtcataagtaccaagatgctacaaagaacttcaccaacactcttgatggtatggggcggattatcaagacaacggcgccacgattactcggcgcaatggtcgaaccgtttaccaaggcgcaaaatccaatttataaagctgtttctaactgggtatctgatcctagaacactaaaagagtttcagaacgctgggaagaatattgctaacacttttaatagcacattgaatggcctgtcaacggcatttcatgggctaggtcaagttatgggacccgttatgaagtcattcggaagcggtgcttgggtcggattctctacgacacttaaagtcattgctgaagggcttgtaacgattacctcgtttgctggcaaagtagcttcatcaatcactggtatatcaaagcgactcggcttcttgaaaattcagcaggcagctgcaaaagcgcttggagttgcatttggtgggcttgtagcagtcatagcgacgtataagacggtgtcacttgcttctactgctgtaacaaagacttttgcagctgctcaagctgcacttaatgttgtcatggatgcaaatccaattgggcttgttgtccttgctattacggcattggtaggcgcctttgttcttgcttacaaacacattaagccatttagagacatggttaataaaacaggagaagcaattaagaaactttttactggtaaatatgattgggaacaatctttcggtaaaggattatctaaacttggaaagagttttcaaaactttgctaagaaaataccacaatttttcaagggtgtcggcaaagcaataataaaaacaattgttattggtttggcgttaccagttggaattggtataactctaatgaaaccattgataaagccgttacaaaacagtaccaaatctttaattaagactgtacaaaagcaatggcaaagtttatcaaagtggcttggcaaattgtttgatcctgttgctaagttatggaatcgtgtttggaacggttgggcacgcattttcagcactgtttggaagtcgttgaaaaagactgcttccagcggaatgaaggcgatcgaaagattgataagtcccgctgttaaggctattgaaaaggtgtgggttactagttgggatgcaattgctagtttcttttctggcatttggcacactattacctcactaggtggaaatggtatgcgcatgctacatagcgccattgcaggcccgctaaatacaattagtagcatttggcattctgtttggaatagcgtttcaagtttctttaggggaatttggaatggtattaaacaagctgctcaagacggcatgaatggcgttattaacgttattaacgctggtatcggtggaattaataaggtttggagtttcttcactggtcacggtactggtgttaaagaactaggccatgttcactttgcacaaggtggtactgttcaccggcacttgtccgttatcaatgatggcgatggccctgactggaaagaattagtccaaacacctgatggcaacttgtttatgtcacaagagcgtaattggaccggcttcttgcctgagggtacccgagtatatagtggtgctgaaacacggcagatcatgaacactgtaggtgtttctcattatgctgctgggggtatcgtaggcgctcagcattttgctgatggcggaattattggcgaaggtatcgactgggctaaaggttcacttgaaaacatcggcagttggcttggcgacaagttcagtgctcttgaagatttcttggctgacccgttaaaggctactaagggattgctagaaaaggcaaccagtggcctatataaaggcttaggcaactttgctgacgttgctcatggtgcaatggataagcttacccagccaattgctgattggtttaagaaaggtttagaaaagcttgaagctcaatttgagtccggtggtgctagtcctgacttaatccgtgccgctgctgctaagatgcacgttgctatttctggggctgatattagccacatcatgaatgttattaaacatgaatctggtggcaatgctcgtgctattaacaattgggatagcaatgccaaagcaggccatccttctaagggtattctgcaatttattgatggtacttttaggaaatatgccgttgcaggccatacaaacatttacagcccgtttgatcaattattggcgatgtttaacgatacgacttggcgatccgatttaacgcttggtggttggggtccaacaggtggtcgccggtttgcaactggtggcgaagtgttcggattaactaatgcaatcattggcgataatcctgaacaccacgaatttgtcttaaatccttatgcggtatctgctgaaccactgcttgacagagcttttgaagctactgcgcaggctcaaccggctaactcatcaactggcaacggtaattctaagctggatcagatgattgatcttcttggaaaggtattagttgctattgaaaaccaagagactgatatttacctcgatggtgagaagatcactgataattctaataagcgtaatgctaaaaattggtctttgaggaaaggaatattatcatgatacaagtttttacacaaagtaaaatcaaaccacatcgctatggttatggagacatggataatccagcattcgatccaattgaattttcaatctcaagagatggtattaattgggtgagtgaatttgataatctagaattaaagggtgtctattgttataaagcccccgatgttcagccagctaatcctgttgataatctacagaaggtagcattaatggatggatctagactgttatctactagctatggtactcgtgagttaaaaatggaaatgatctttataggaatggacgaaggcgatgcaatgcttgcttatgatgcactgcaacgctttttaatttctcgtgatccttactggatctgttttgccaattggcctcaacgtatgtattatgtgcgggctaagttagcagcaccaacttttacaagtgaaaaagcatggacctgtgaagtaacatttaccgacattattgggttaagtcgaagcgttggaactacacaagagcctgtgctaggatttggcaataatcttgaggttcaacctagatattcgtttaacagtaattcatttactttggttaatacgagtgatgtgttgattgatcctgaacgtcgcggacatccattcaagatgacattgcaaggctcgtcttcaggaaaaatgaaagttactaacacaactaccagtaccagcatttataaggaaagcggctttaacggatcttttgtgttagatggcgttgaaccatcttgtaacggcaagaattgttcgctagatactgattgcggaattattacgttacagattggcgaaaatcatttcaaagtcgaaaacttcaacgggacaatttcatttgattatccggactggtggttatcatgagtgagtttgtatggctaactaacggaattagtaataagctggcaacggaagcacgtaaagccgattggcaggatatgcacacatcatttaaggctaattttcagttgagttcagcttatgaaatctcatttacactaacttataccgagcaatataaagatgcttttaatctagtcaaagaaaaacgctatgtaaattatcgtggtcatgattacctaatccagcaagtggaagccaaacatgatgaaaatggattggctaccctgcaagtaacggctactcatcggctaattgatgctatgaaagatatagtcctttattcaacaattccgacagaaggaaatcctgaggttagcggtggcggtagtagtgattctggagatggtgatagtggtgatccacaaccgggtattgtcactaaacaaaccgccgttcaacagacctatccactaaacgaacgattggatcatttctttaatccaaacgaatggggaatcacttacaagctacatggtaatttcccacaagcagcagttgactgtactggttcgttatatgaatggttgaacagtaacttaaaattatttggtgcttattggaaaccagatagtgacatggttgttggcatttatgatctggaaagtttaaaaaagcctactaataaagtgtttcgttaccttcatgatatgtctaacgtagacattcaaagcgatgctacgaatttaattaatgatgtttgggtttacggcggaaaaatggaaaaagacattacttctgttcttggaccaggcggtcaaaccaacggagctaccgaaccacaaaatggtgactggacgccggttatacagaatgctgcttcattaattggagaaaaattatcagatgctgatattgctaacattaaaaatcgaatacgaattgaatcaaatggtaatgaaacaattcaaaataattgggatagcaatgcacaggcaggccatccgtcaattggattagtacagttcattcaatcgacatttgattattattgccgtccaccttataccgatattcgcaaaggattagatcagttaatcgcgatgatgaacattccaaactggcgacaacaaattgccggttctggcggttggtctccacatggtgctccaattagtaaagctaccattgacattaaatcagtcgttgataacagctggggatggcctttcccgtgtggagagggtcatttccttggcggtcagttatttggagttaatccgggcggtgagtttcgtcgtaatggattccatgatggcttagactttggctcgattgatcacccgggaaatgaagtccatgctatccatagcggagaagtaaagacgatcagttggggtgacggaggaattggattctatgtagttattcaagattcttccggactcaatgttgaatatcaagaggctttttccaatcaaagtaatattactgtaagagtaggtcagcaagttaaaacaggcgatgtaatcggctatcgaaccactaatcatctgcatgttggtattaccaaacataactttccggaagcttttagtcacgctttcagcaatgacgggacgtggattgatccgcttagtacaattaaaactggtattgctaatggaggctctacgcctgtaagtagtagtgatggggagtcaactacttcaactactagtgaaacctattactcacttgtatatcattttgaaaatcaagaaagtatcgacaaatacggaagacgaaagggtgcacctattacagttgatagcatttatgatctggatgcattgaagaagtatgctgaaaatactgttcaatacaatcccgatacaacacttactatcagcgactttacaggtgaagcagaacttggcgaggttattagattaattgttccagagcgtaatctaaatactgatgtcacgcttgttggcgtatccggtaatagcgattattttgatccaaatggagttaaggaattggcctttaataatactggcttagcgatgaaagatgttaatgcagccattatgaaagaccttcatgacattaatacaggtacacctcaattaaactactatggagcaactggtggacgtgaagaagatcactgggccaatattaaatttaatgacaagcagatggactacttaaaatcagtaactaaagcaggaggtgagattaagaaagatggcaacaaacactgatggacgtgaagaaattaaacctgttgcaccaaccgagcagacaaagtggcgtgatcccagcctggttggcaaatacatggttgatcctaaaacaggattggccggtctttttcgatcccctgacaatggtgagacttgggttcttaccgataccgtctatggtcacgtttataatcaagacgaggttgacaacatttgggacaacggtgcagctcataaagtggcagatgaaatcaaatctgctacggctgacttgccaaatgtccgtaagcaagctgatgaagcggtaaaatttgctgaatcggctattgctgcaagtaaggtcaatagtgatgcgatcgttgcgcaaagttcggctgtggttgaagcaaagtcagcaatggatagtgctacggcggaaattcagcaattaaaagctaacgcagctagcgatgttgcgcaaatagaatcaactattgctgaggtacaggctggtgtcaaccaagcaaaatctgccaataaatcagccgtccaagcagttcaagccgaacttaaattgacaagtgactcgatggataaagtcgaaaagcgattagatgaagttgatactagccttgacacttatgctaaaagtgctacggaacaaggccatgacatcactctgattaagcagaaacaaggccagttcgaggctgattttgcttctgcacagggaaatgttaatcagattcaggctgatatcaaaggtttacgtcagaatgtcaaagacaatcaaggcaatattgccacgttgctaacttctgctgataagttgcaagcatcaatgacagatgcagagaaaaacatatctaacctgcttttaacagcaagcaagtatgagcaaacgttcaaagaccaagacgggcgcttgagtaaagttgagcagactgctactgaacatacgagtgtattggccgacgcaaagggtaatattgataaggtcacgcagaaagcagacaatctgcaattattacttagcgatgctcaaaagaatattcaaaatattcagcttgatgccaaaggattgcatgacacgttaactggtcaaaataatcaattggctagtcttaatgtgacacttaacaacttagatagtaagtattccggtattactggagacctgcaatctaaacaaacggctttgagcactgaacaacagcaaactaaggatatgctattgcgtaaagctgataggtccgaagttgatagcgttaaaggaactgttaatcaagtcagtgccgaacaaaagacaatggctgaccagattaatcagaaagtgtcatctgtcgagtatcagacattgaaggataaagttaatgggatgaagattggtactcgtaatcttcttcaccattcagacacatttgacggatggattaaaggttattcagtcgctgttacagcggataaatatcttgatggtagaattgctattcttggaggcgctggtgtagacggcggacaacttactacttttctggatggtccatataacgatgatctagtaacatgggtagtttatgccagagcagagaatgctggagataaaatgcatacagaattatggggaggcggaggttgtacagatcaaagcctcactaccaaatggcaagcttataaattttctggtcatagaaatattgatcaccctgacttttatttgtggggctgcgttggtaacaagggaaatatttatgtagctttaccctttgctgttgttggaaattatattggtacatggttagctaatcctactgataccatcacctctattaacaagaatgcaactgctatcgatgaaaatagtaagcttattagtttaatggcaaagcagactgaggttgacaatgtaaaaaatacggcgcaacaaattagttctcgtcttgacatcttagctggtgaagttaaatcaaaagttgatgaaactagggttaatagcattgttgacggtaagggctatgcgacaaccagcacggtacaatcattagtcgatcaaaaagctgggacattaagcgatactatcacagagcttgaccgaaagattggtgacaaccactccgattcaatcaaacgtatccagtcacttacggcttcaattgacggcttgcagtcaagagttaccaactatcaaaatgatacatcctcaaagtacacgcaactttcgaacatgatccagtcaaaggttagtgccagcgacttcaacgctttgaaagacaaggcgacgtggaagagtaccgacagcattgacctcaacaccgccgtgttacagcagaagattttcgtcaaaggcggatctaatctgccaccgggtaactattggtggtacgtgcaggttgaacccggctatgacagccgaatcgtccagtacgccgtgtctgaccgggacaacattcattacagccgccagtacgacggaagtaaatggtctgcatggacgcaagatgctagtgagagtgaaatcacccagcttcgtgatgatattaatctgcgagttcaaaagggcgaactgctgtcacagattaatttaacggctggtaatacgttgattcagtcaaataagctataccttgatgcttcatccgtagtaattactggaacggcctttattccgagtgcggcaattgctagtttgagtgccgataagattaatactggaacacttaataccgacaagatatcgttgagtaacggacatgtaagactatcatctgatgatgaccatttttatgttcagacagaagagaatgcggttaataaccctacaactcggtttaattttgatggtatagacttcatggatagctcatatggtaaagaagttcctcaatatagcattgggtatgatacttctagtgctgatcgtcatttatatatcaatgcttttgaccactttaactcgggtgggacaacagctagccaactatggtattcaatggtacccgctattagtctgaataatcaggaaattaactttgctgctaaaggtaatatgcatatgcaagtagttgatggcggagtaaatattaagccaacgttatttttccaaaataatactaataatgggacttatactggctttacccgtcttgataattctaatactgttgaatttaataccggtgataacaacggcgagaacttccatgttaattctggtgctcgcttcatgaagtatgtttacttcaatgattattgccgagcacaaggatggctcacttattcgaccctatcaaagaagacaaatatcaaaaagcttgatactagtctggcgctagataagatccgtcaagatgaccaatacctttatgagtataagcggaatgtagctaagggtgtttacgatccgcaagctagtttcatcattgatgatgtgaacgatgtatcacaatactcagttccacgggaatttattgatcaaagcggtaaatatcgtgagccgagtgttgagctgtcatacctaatcgccgcctttcaagaaattgataaacaagtgcaaacacaaaaagaagaaatcaaagaattaaaggagaaattacaacatgaataacaatgatttattagtacaaaccgcccgagaattagctgctcgtctttcaaatgctgagatcgatcgggctagtttccgagctcaagcaattgagttacagaacgaaaacgatcgattaaagaaacaaatcaatgatttgcaagatgagttagggaagcaaaaacaagcaaaaaaggatcaatcagaagtagcacctaaaaccgttaccgatgatcaagacacaagcaccacagaaacagaacaagacccacaagccaataaataagctgtgggcctttttagtacaaagattatttaggaggaatttatgatgaacgaaacacaattaagctcatttaactaccaatttgatactaataccggtaaatgcctttatgcgcaagttggcttgcataatgaaagtgctgatagtactgaatttgtcaatgcttcaattcgggttaaaccggatgatttaccagaaggcaaggactttatgcaattatcaatgaaggacttaattaccattgctaagcagaagctcgccgctgatacagctatcaaaaaggaaaaccaaaatactgaaccgaacaatcaataatgaggtggtaacatgaccaaactagttgcgtttggcgattcaatttttgctggttgggacggaaaagaaaatgtttcagccaatcaacggatccctgaattgattggtcaacacttaggctggcaggtaaccaatgtagcgattggcggaactaagtatgacaatagttcaaatggctttacggcgatggtcaataagactgacgtatcagggttcgactatgcgctagtaagttatggagttaataacttcagctggcccgaagccttagcaactgttaagcagaatgcggttaatggttttgaggcgttaaagcgtaagaatcctaacattaaaatcttgttggaattgccgactgaggactttcgacaaggaagcaagaccctttatgatgtcaatgatgccttttggaaccagaatcagttagacgacatgttaattgacgttgccaaacaagaagggcttgaatattacgactggcgcccagatccattaatcacctacgaaaatgctaatcaaacactgggtgacggtaatacaggagtacacccaacgaaagcaacgatgcgagctattgctcaacggctagcagagaagtttaagcaaatggcaggcggaacagttcaaccgagtccaccaccacatattgaccctcctcacgataatccacctaaaactgataagccagaaaataagcctcaaccaccagttgttaaaacagttgatgagttgaggcttgaccgtttagcagatttatttgggattggtaccaatgtgagtaacgggattaaccggacgctcaacaagattaatgaactttatagccaaatgcacaatcttatgggaacggatagtaagcaggttcaggcaacgttaatcgctcccgacaatgcgcttactcgtccgcttcgcaactatgtattattaagtttcttcaacttagagcgagaagttaacgagctgattagcttatgtaatagcaactggttatgtgaccctgaaacgggtgctaaaactagcctattgcgattgctacgtgttgacagtttggcgactgatgctcattacaaagataccgttaattacaactggtatctgattgaaaacaaattaaacacgttaattggttatattaataagatattgaaaggagaatgataatggctgatttaattgaagctaaagaccgcaataatcggattatccttgataccacagtttcagccgatactacggttaaaatgccagcaatgaatggtcatcaaggcgataacgggcgagttgtgccatttgttattgtacaaggtcctaatcacctgccaatgaatatgcaaggcaagtcgattgaccttgtgggtgttgaccatgatgggcggttaaaaatttctggtgccacttacaaagtaattgatccatctgttggtacgcttgactttacaattccgggagcgttctatcaagcacttggtgattatcagcaagcctatttccgtattaaggacagtaacaatcaagttatttcaacgattaatgttgcctttactacgctagctggtgctgactatatgacctatggagattctaaaatattcaatggatatgtaagtcaaagcatggctggagttgaacaagaagttgctaactgggttaatcagcttaaagcaatgctttcaggaacagagggagcagcagatgttgcccgttcagcagttcaagcattattagctgcaatctcggctaaccaagtggcaacttttggtgggaacaataattttactggtgagaacaagttccacggagttactgagattgacaacttgcaaggaccagctcgccaagcgctattcaactatactgataacaagttcaatggtttaactagccagcttaattcgattactggacggttagctaatgtattgagaaccgattccgcttggactcgtgattataccttaggtggttgtctgtcacgtgctaacaacggaaatgactttgctctctctaagttccatattatgcagaatgtgaacctaattctaggacgtggtgatgttaaggtcgacaatgaccaagactttaatgaatcacaaatctatcttccatggaccgttgataacgctgatgtggcaattgcacagatgtatcactttgaagggtatgctttaccacgtcttgatattgatagtaagaagctcaatatcagtcttaaaggcaagcgccacgaaattgaacgacttagtcttgtaattattgcatttgacagataggggtgagcaatatggcaacaatctatgtatataacaagaataacctctttgtgggacgtaaagacaacattaacttagaagcatatgaattggcggataatgaatccatcaataagccgcaaacagtttatgaatatgacgatagctatcacctaactggtttagccaagattaagcccggaacagtgattgccaatgcaacgcatactgtaccaccagatggattgaatgatcctacttatgatccagcaaataatacctggcatggcattagtaatgatgaataccgaaagctatacaacgttccagcaagtgaaccagacggatcagctaaattaatcaatgctttaacacaacaagtctttcagttaacgcagaaagtaaatcaactagaaaagagtgatcagaatggttgagataattagaatgttggctcagcaatatgctgatattcgctgggcggttgaagatggggcaattacgaaggaacaatacaagaaattcactgggaaagaatattcagaatagttgtataattaatccatcaattaaaaggtggattaattatgtggaacgtaattggaacaggtttggtagcaggtcttattgcgtctatgacgaatattctaattgcacatttaagcaatagaacacaaagggagactacaaaaatgttaaatctcgaaaagacaaatgaagttacattagagtggaacaatgaaactcgtgatcttattagcaagtttgtcaaagcgtgttttcagactcatcaagtctacaatgcaaccgatggtttagtagggcgtttcagtgaagcaataaagtcaaacagcaatgatcgagtttttgacaacataactgaggatgcaaaagcagcgattaaaaaatcaaatcagacttcgagcgagttatatgcactgcaagcccaaatacgaatgcacttatatgatgatcatgattatctagtaacagacattaataatcagattgagaaagttattgaaaacctggaatcgaatagatctctgccagcaaaagagattgatgatcttgttgatttgtcacgagaatatttttccattcaatgggaaagaataaagaaggagaacgtccgatagggcgtttttattttgcacaaaatagaagggagaaacaaatgcgaacactaacaattgctgataattggaaagattggaagttcggtgatacggatgcagtaatgacttttaatgctcaaaatgatggtcaaacaccagactttaccaataaaacactaacttttaaaatcgctgattccgctgcttcaactccagataatcctaaagattatgtagccagtgcagccggttatgttgaaaataataaggttctgttaaagaccgaagatgttaaaactctgacacctggcacgtattctgttgagttgtgggtaatggataattcaacggaaaagaatgctatttatccatctaagggctttgcgttctttagtattgaagaaaacacaatgaaggtctcagatattacaaatgtaccctctaagacgctagaagctatctatgcggacttaaagcaacaggtaggggccatcaagaaaggttctcagggggaaccgggtaagacaccaaagattgttatggggtctgttactaagttgtcaccggatgctcaaccatcagcaaccctagttccattacaaagtgacccgaatacttacactttgaacttgcaactacctcaaggtgtccaaggtgagcaaggactccaaggtattcccggtgttggtagtaagggtcttgatggtaacaatggattaacgccaacaattgaccctaagactaaacactggatgattggtggcaccgatacaggtgtgattgctgagggacaagcggggaaagacgcagaccctagtaagtatgttacgattgtgtcttttaatcagttgcgtcaacaagtgcaggacaacgcaactgcattagatgcgttgcaaaagtcggcagtaaataaagacttgcaaacgcagattgctaacttaacatcacaagtaactgatttaacagcacaagttaaagctttacaagaagctaagtcggatacgtctaaatcagacgagccagctaagagtgataataaggatgaccaaccggctaagtcagatacgccgacttcatcagctgattcgccatctactccagcaagctcatcaactacgacaccagatagcacgccagcgtctagttcctcatctgatacatcggataataagtcagctagttcttcagctgaaacgagtgcaacgcccgcttctgacacaactaactagggggagattaagtaatgcaaacaatgcacttcttacttgcaatggctccacccccgtatcatcaacagtattttcagcattttcaaggaatggaagataactggataatatggcttttcgtgtgggtaattatcattgacataataacagggacggcaaggagtttagtaacgcatcatacaacatcaactaaaggcacatcaggcttaatcaagcatggcatcctattaataataatcctgacgctttatccaatgcttgatattaatggtatgaaaagcgccggcgatacctttacgatgttttatgtattattctatgctgtttcaataattgagaattgcggacaaatgggtctacctatcccaacatggttgaaaaaatatatctataaactatcggatgaatataacgacgattctcaaactaataataagaaaggagtaaatgatagtgaaaaataaatcattcaagaaagctaagaacttagcactagcaacaatggctggtgcttttttagtaggttcagcaagtgttgcttctgctaataccggttggcaaaaacagaatggcacttatacttactatgaaaataatggaaaagttgaaaggggacgacaataccgtcaacttcctaaggctaatcctggaacaagctggtatttaacccaagacgggaagatgttgactggcgttcaacaatggcaaggttcttattggttctttaaccaagacggcaccctccacactaagcgtgattatgtgcaatcccagtggggcgattggtacatgattggtgataatggtcaagtgctgtccggcgtccaacaatggatggggagttattactattttgagccaggaacttatttgaaagctaataagcaagaatatgtaaaatctcaatggggcgactggtacatggttggtaaagatggtcgtttaatgagtggacttgttaactggcaagggagcaagtactacttcgacccatcaacctatctcaaagtaacaaataccgacgtaacggttaatggcgttacctaccatgcggaccagaatgggattctttcagaagtgcaaaacactggttttactccatcacaaatcaaccacacctatgacttagctgattggcaaggtagtagccaaactgcaatcaacgattacatcatcatgcacgatgttggcgctgagtctggtgccgctgccaacgctaactatcttcgtaacaattgggaatcagcttatacccaattcgttgtcggtgatggtggacaagtctttgaagtcggtgaaccaggttatgtttcttggggtgctttgaacgctaatccatacagtccatgtcaaattgaattagggcggacatacaaccgtagccaattcattaaggactacacggcttatattaacgtggctcgttactacgctaagcaatacggtattccgctaaatcttgatgccggtggagcaggtactccaggtgttaaaacacataactgggtaactgaaaatattggcggatcacatgttgatccatatggttaccttgcaagttggggtattggttacaatcaatttgcttctgatattgccaatggtgttaaccaacagcaactcaattcagttgtttactcacaacgtcaataaaaatttagccctagtggttgttgcagattatgcaatggtcactggggctttttgttgtataatttcgtatattagatataaccggtttcaatagtttggggaatctttgtaagtggtaagccgagtaacaaaccaatgatgaatgatgtgattactaaaccaacgaaagtgttcatctttagtttaacaatcatgaaaattaagataataactccgattaaaacaataagtaaaggcataataataaccccctaatgaatagattgttgttgtaatttagcgatggtcgaataggctggtgttaataatccctcaacctgttgaaagagtggtaagtaattttgataaacattaaccgcctcttgatttggttgataagaactgatatcaccaattagtgttttgatgatttcatagttttcaatcattcctagactcttcatggccatggtgattgcaccgagacaaccggattcaaatgagttagggatattgactggacagtttaagacatctgctaacatctgccgccaaacttcagcccgcgcaaaaccgccagttgcagttacgcttgcgggattaccaacaaggtcacgaaccgcttggaaaacagttgcaatattcatacaaattccttccattactgagcgcagcatatcggcacgggtatgaatgtgggaaagcccaaagaaactaccacgcgcatttgcatcccataatggtgcccgttcaccgccaaggaatgggtggaaaagcaaaccgtgagctccagcaggaacaccttcaataacctggttagcaagagtgtaaggatcaatattttcatttttaactgcactagcgtcaactaagtgctcaacagcccactgatagacatcgccaccattattaagcggaccgccgatgacccataagcccttatccacggcgtaacagaaaagtcgctgctgaggatcgattactggatggtcagttacaacccgcacaccagcggaagtcccaatcgtaatggcaacagtattttgcttaattgctcccacgcctaaattagataaagcaccgtcaaaagcaccatagacaaatggcgtgtcagcagggatgcccatttttgcttgcgctgttgctgttaagccaatcgcttgggttgttccgttcacgatttctggtaattgggaacgatcgacattagcgagttccaatgcctgatcattccagtcacacgtattgacattcatcattccggtacatgaagcgatggaaacatcaaccttaaacgtattgaaaaactggtggaagaggtaggacttgatgtcgccaaaatatgcagtttgggcaaccttatctgcttgtgtcttgttgagccacataatcttggtcaatggggacattggatgaataggtgtacctgttttagcataaatttgctgaccggctggactattctttaattcgtttgcgacatcgcgcgcacgtgtatcagcccaagtgatcacccgtgaaagaggattgaaattcttgtcgagcatgatcacgctttggttagcactggaaaatgataccgccaacaattttccgtttgttaaatctgctttttgtgccgcatcatgaataactttttcgactgcttcgacaattgcagttgggttttgttcagccattccactagcatcgcggtaaagggaatagccttggctaaattggtctaacacagttgcattttggtcatatagaactgcttttgtagaagtagttccaacatcgacaccgataaaataattcattgtagtaattctccctttattaatttgaaaacgctttagtttatcgttacacctaataatatactgttgtatgtaagcgatgtcaatagcttatttaagattagtttatcgatttcctaaaaattaaaaatcgaaagtgattgcatcttaatattgaggtgtgatactattaattgcttaatttgttatggtttagctgtaagcaacgattttaaggagggattacaatgaaaatccggaaagcaacaatggcagatttagatgtagtagtagatattttacgtgatggacgtaaccagttagctgagcggggcgttgatcaatggcagggggattatccgaacgttacccatgtaaaagaagacattgagaatggctatgcttatatcgttaaagcagatgatggacaaacagttggcacgttagcaattgttgaagcaccggatcatttttatgataaactcaacggggaatggctaattaatactgaaaattatgttgtaatccaccgcgtagctattcattcacggcatgcaggaaaaggatacgcatccaaattatttttgagtttgattgaatatttggagactgaacgtccagagatcaaatcaattcgtttaagtacaaatgaaaataatatggcaatgcaacggatcgcaactaagagcggctttaaaaaagtagggaccctccatggagtttttcgtccaagtgagttgtcttatgtttatgaactgttaacaaaagtgcgtgtagcatagaaaagaggagggcgttgatcttgtaacaccttcctctttaatttcactatttttcattaattttcttagcatattcgcgagcgttgtaaagttcgtagactacccatgtttcaataagggtaatgacacagatgagaatagcagtatacatgtctggtaaaacaaacagtaagagtaagaagatccatgaaatccatgaccactgggtttcaattgtaacgattcgctgaactcgtttagtaggttcgatacgaccagattggttaaaaatggtccgaatttggtaaaaataacgaaaaataacgaacttcaaaaatactttcgataataaaaattgctgttaagatgattaataaaatgttcatcataaataagagccccttatctttcgatttatctctaattttagaactcttgggcaagagaagcaatttagatagtaaaaaaataggtccctatcaaagattgagtgataggaacctatttttaattctacatatcaagaaattaaacgttcattgtcttaccatattcattattaatggtatcaacaacgtccttggcatgcatatcatcttcaacaactgtttcaccatcacgaagagtgtactttacactttcgtccaagttatcaaagtctacatcattaccatctgcatctacaaaattgaacttcgaatcttggaagttcttaagagcatctgcattaatttccatgattatgcttcctttcgccattatagtaacatttaattaacgaaaattacagtaataagataaatggtataaaaggtttaagatcattgacacttaataaggaagtagtatggcgagcattggcatagattttaagagggaagagaaaggtatgactaacaatagcacatctcaatggtgtatttttgctggtacgggatcactacggggatgatttccagaatggccaagataggctgagagaagattttacctttacggacattagcgcgggatacgactaatccgccgtaacatatgctacaacaattaggtgcttttgcaaagtttactcatacctatgttctttattctactgatcagaagatttattgggttgcactaattttacattttagtttttcaattttctttgcataatttctaatttacatggtacagtataacaagacaaaatggattgctatgtggatggtgccttctatgggattcttatttggattgtatggcatattattcttatggcttttgggatattccatttgatgaaaattcttctgaattctttggacatattatttgaacctggtcgatcgttgctgttgtatacttcttgatcggtacgtaatatgttaagactttgaataataagtatttgtaaaacattatttttattaagtgaggaaacaataaaggattgttatctcgtcttttttattgcatattttaaaattgaaagcgcatccaaacgatgtataattaaaatgtaatgtacaattttggaggtattgtaatgaaaaagcattggaaattgcgttttactctctccttattagttcctttagggttcaatttattttattctttaccaactcatgcgtctgaaactaacattcaaactaatgttaaagttgatgctcaaagttcaaaaacgattacgagcactgaaaatcaatcagctcttgtaactgcacaacaagttaaagatcaacaaatcgatagtcaacagttagttaatgatacatatcaaaaaatagcggaaaataaggatcttaatagtgtgatttatcaggatccagtaaatgcacggcaacaggtaaatgctttgccagatacaaacactacttcagagcagcctttttacggagtgccaattctaattaaagggttaggccaagcatataaaggatatccgaatacgaatggacttccgtatatggaagataatcgttatggttatactaaaaattttgtggcaaagttgcagaaaatgggatttgtaattgttggtgaaacaaattatcctgagttaggattaattaatgttacagattccaatttatatgggccagcgcataatccatgggacctcacgcgaaatgctggcggatcttctggtggagcggcggcaagtgtggctgctggaatagtaccgcttgcaaccggaaatgatgctggtggttccttaagaattcctgcttcgtggtcaggtgtaattgggttaaaacctactcagggaattattcttggagattcattaacgccttcagtggttaactttgcagaaacgcggcggattgatgacacgatcaagttatttgagggcttactagatccaaaccggaaatcattattgaaggaatttccgcttaagctccaagacctaaaaattgcatattcattaaaatcaccagtaggttctgttgttagtgtggacgctaaagcagctgttttaaatgcagtaaccttcttacggcaacagggctttcaagtagtcgaaaaggatagtccggttgatggggtaaaactgatgcgtgcttattatttaggggctttgagtgacggaacagttgctaattatctggctcaacaaaaactgcaccgtaatctgcaggctagcgacgtcacagagcatttggttagtccgatgacatatgcgttgtatgaagctagtaaaaaagcacccaaagaaataaagcaaacttacaataatgaattagcgttagttgctgctcagatgaagagttttcatgaagaatatccgatttatttaacgccaactaccgcaacggttgcaccattaaattctgatccagcatttttaccagcagatgttgctaaaattttgcaaatggccaagatgccttttgatcaacaaatggatgttatttacaatgcttggtatcatggattaagtaaaacgccatttacgcaattagctaatttagcaggagaaccggcgttaagtttgccgacttatgttaacgcacaaggattgccattagggattcagttagaaggagaaaaaggcagtgacctgattttattagcgttagggaaattatttgaagagaaaggtaaactaatcttcctaagtgattaccaaaagttaaacaatgatacccagcctagtgagccacaaaatgaagacgcagcaaatatctcaaaagttgttgtccacaatttaggcaaaaaatcagtttatgaattccaaactgcctcaagtaaacttaatatttcagataatattagtccgaaatatgtagtaaaaacttcgcaacaagtgaatgctaggaaattacaatcgacaaaagaaaagcagttaccacaaacaggatcaaataataatgatgggttagttttgcttggattagctttattctcattaagtctgacaagtgtttatcaaaacaagcgaaaattttgataaacagttttgactaatcctgtacataatttataatatgagtaggaagagaattcttggattgaataggaggaaatagatatgtcattgatgcaaaatacctcagaaattaacaagactgataagcaggtgtacttaatcactttgttgcggaagagtacaaacatgccacaatacattgaccatatgatttatgaaactgcagaaggtggtcaagaatttatggcgcgcttagtcgaagctttttcacgggcaggttaccgggaaaagaagcttagcgacgacaagtacaacctcgataacggacttgataagatcactttacggggttcataccaacctatttacaagggataattaaggttaataactaaattaaaagagctgatgctacattcgaggcaccagctcttttaattaatcatcgtttcgtaatgatggaacagtaatatcattaccgtaattggcactccaccacccatgcttgctgacataacctgttggcaagcagagaatcactaagaagattatatcaatgactgaagaaatagtttccatcaccgcactatcgttacttgtaaaaataagggaaagtaaccagaaaaccaacacggtccagccagtcaaaccggtatcacgaacccgccggacacagatagcaattccgggaataataatagcaatagcgaatactgcaataacgaagagcaggaaaattaagaatccaacgccacgattatagccattcataatcgaagtgacagaagcaaaaccagcgattgctagtaagaaatataaaataacaaaaatgatgaaattaaccaatactggccaccaaaaatccgcccgcgttgaagtagcccggtacttaaaggcattttcccagtagtatttgtaagcttcaaacatacaattctcctcctttgataggtttgctttgattatagcatttttgcggggatgtagattgacttatgatttggggaggagaaaaaatccctaactgtgactaacacattagtatgctaacttttcacactttacgttagagtatataatttataggattactaattgtaataaatattgattttaaggattgaaaatatcatgtttataatataaagaatagttaattatgattttttaacagcgtcatcaattaatgaaaaagatacgcaaattttataaaagtatggaacgataggagtttttattttggcaacaaagtctaaagagctaaatattgaagataaattatggaaggctgctgatgcattgcgtggaagtatggatgcatcagaatatcgtaatgttgtattaggattgatctttcttaaatatgcgtcagattcctttgaagaaagaagacaagaacttttaaaaacagaatatcctgaagatgcagaagatccggatatgtatctagaaaataatattttctgggttcctcaagaggctcgttgggcaaagattgaacatgctgctaaaacacctcaaattggtgaagtgattgatgatgcaatgactgcaattgaaaagagcaatgattcatttcgagggattttgagtaaaaactatgcttcaccagatcttgataaaacacgcttgggtgaagtagttgatttaatttcggacattaaggttggaactaaagaatctacagataaagatgttttaggtcgtgtttacgaatatttcttaaatgaatttgctagtcaagagggtaaacacggtggtgagttctatacaccacggtcaattgttaaaatcttagttgaaatgattgagccttataaaggacgtatttatgatccttgttgtggttcaggtggaatgtttgtccaatcagaagagttcgttcgtcatcatcagggagagttgaaagatcttcacgtatttggtgaggaatctaacccaactacttggaaattagctaagatgaatttagcgattagaggaattgatagcgacttaggcccccaccaaggcgacactttcactaatgatttacataaaggtgttcgtttcaactacattttggctaatccaccattcaacattaaaaactggggtggcgaaaagcttcaagaagatgctagatggaaatatggtgttccaccaacaggaaatgcaaattatgcctggattgaacatattattagtaagttagcaccggatgggaaagctggctttgttttagctaacggtgccttatcgacttctaataaagaagagtttgctattcgtaaagcaattttagaagatgataagattgatgcaattgttgctttacctgaaaaaatgttttattcaacggggattccagtttcattatggtttgttgatatgaataaggaatctgaggatgaacgctcgcgaaagggtgagacattatttattgatgcacgtaatttgggtgagatgattgatcgaactcatcgtgcatttaatgatgatgatattaaaaaagtagcggatacttaccatgcttatcgtggtacaaacgatcaagaatataaagatgttgctggcttttgtaaaattgctaagttagatgagatcgctaaaaatgattatgtattaacgcctggtcgctatgttggccttgctaaacaagaagatgatggagaatcatacgaagttaaaatgaagagactaactagtgaattaaaagaacaatttgaggagagtaataagttacaagctcaaattaaagatgtattgaaggagcttggatatgaaatataaaaaaatacagcttaaggatgtagctgatatagttatgggacaatcacccaagtcagtcttttacaatactaatggaaatggtactccgtttcttcaaggagtaagaacatttggtgaaaattatccccaaattgatacatggactacttcttataatagaaaagcgaaaagcggagaaatattgtttagtgtgagggcacctgttgggagagtaaactgggctaatcaagatcttgcagtagggcgtggattagcagctttaaaaattaaaagtggctattcaaaagaatacttatactatctttttaagaagattggtggtcaattagattcactagctactggaacagtatttacttcaataaataaaaaagaattggaagctatagagctaaaaattcctgttaatttaagtgatcaagaaaaaatagctgattatttacagaagattgatcaggaaatagagttaaataatcagataaatgataatttagatgttaaaaatacttttctaacagctctttttttattgctaataatttttcgttttcttcttctaattttcttaattgtttaaaaattggttttgtaatttcgttaaacttagaagtatcttctgaattaggaatattaattatatgctgtttgagttttttacctgatatttctttgaatgtagaaccattagcttcattttttattgcagcagtttcgtgctttaataattcataaataaattgaaatgaatattctttattagggattacagacttgaagccttggtttgtagctaaattatttttagctatagaaatataaccaataggtgctcgagagctaaatagtatagtattggttggcaataattttgcacttccttttgccaatcctaaacctgtaatgtaattttcaccacttgaagtaaaaattaacggatgttgagacagatctttgggagttacccaagcaatatctccattccaataagcagctatttttttagacggagtaccaccaccaactactgtaccaatatcttcaatagttttttctactgttgttacattatttaggaaatttataaaatatgaatcaactaattcaactaaattatcatttaatctactaagcaactctctgtggtgtattatttttcaaaaacggagaattgattcatgcaaagagtagagtctgaaaaattgattcaaaaaatgttgccatacttgaataatcaacagttattatgtctaagaaatgcactagatgaactaattactacagaaaataaacaagtagataatcataaggataaccagcagctgcttactaaatactttgcttctaaaagagcagaaggatgctcggaaaaatcattaaagtattataaaactactattactaaagctctggcctcaattggtaaaaatgctaaagaaatcgtaacagatgagttacgtaactacttaactaattatcaagaagttcataactctagtaaggtaactattgataacattagaagaatcctttccagtttttttaactggctagaagacgaggactatattatcaagagtccagtaagaagaattcataaggttaaagtttcaacaactgtgaaggaaacctataccgacgaagaactagaaaagttacgtgataattgtaaggatattcgcgacttagcaatgattgattttcttgcttcaacaggtatgcgggttggggaattggtattgttgaatagagatgatattaattttcaagagcgtgaatgcattgtttttggtaaaggtagtaaagaacgaattgcttattttgatgcaagagctaaattacatttgcagaaatatttatatactcgtacggatagtaatgaggcattgtttgtttcgctatacaggaaacatactcgcttaacaattgggggagttgaatcacgattaaagcatttaggtaaaagattaggaatttcgcgtgtatatccacataaatttagaagaacgttagctacaacagcaatagataagggaatgccaattgaacaattacagcgtcttttaggacataaacgaatagacacaactttacattatgcgatggttaaacaacaaaatgtaaagatagcacatagaaagtatatagggtgatgaaatgatttataaatacttaggagatattgctgagattaaaggtggcaaaagaatgcctaaaggaactagattgcaacaagaaaaaaatcaacatccgtatttaaggattactgattatgatggtaaaagttttgatcgtaatagtattagatatgttcctgatgaggtgtttgaaaagattagtaactatacagtaacagagggagatatttttttatcaattgttggaactatagggatagcgaccacgattgataaagaatatgataatgctaatctaacagaaaatgcagttaaaataattcctgatgagtcggtaaattccaaatatattttatattttttacaatcgatgttaggacaaagacaaatgaatgaactttctgttggctcaacacaaaaaaagttgcctataaaaaacattaaaaaaatcaagattcttttacctaatttagaaatacaaaataaagttgtatctaatttacaaatcttagataaaaaaatagctttgaacaatcaaataaatgataatttagatgctttattaactaatatattcaaaaaatatatgattaatgacggttttgaaaaatcaaacttaactcaaattgcaaattataaaaatgggttagctatgcaaaagtatagacctaattctaatgaagaaagcttaccagttcttaaaataaaagagttaaatcaaggaaatactgatgattcgtccgatagatgttcggctaatcttgataattctgtaatagttaatactggcgacataattttttcgtggtcaggaactttattagtaaaaaattggacgggagacaaggcaggtcttaatcaacatttatttaaggttacctctaataagtatcctgcatggtttatttatgaatggactaagtatcatttattgaggtttcaagcaattgccgccggaaaagctacaaccatgggtcatatcaaaagaagtgatttaaaatcatcactagtatatattccctctcaattatttttagcgaaaatggatagtcaactagcaccaatttatagtcaaaggttaaacctaattaaagaaaatcaacaattatcgaaacttaagcagactttgcttaagaaatatttttaagcaactaaattatcatttatctccctaaatcaaacagaaagaggtgatttattgtggcaagttatcttaacgaagaaaatatagagggcattgctttaagatgtcttgatgaagtaggctatcaagtctacaaaagtgctagttatactagtccgaatgtagaaatagatgctgaaagaaataatgaccatacacaacctattttaaaaggacaattagaaaacgctttacgcaagttaaattctggacttgatgatgaagtataccgtaatgccattcatcaatttgaaatgctagcagatagcccagatatgatgcttaataaccataaacttcatgaattaattatcggcggagcaaaagtaaaaacatcaattaaaggtgaggaccggaccattactttgtatccgattgattttaaaaacgttgataacaatacatttattgcaacaaatcaatttacaatgaaacaaggagaacatgaaagaagaccagacattactctttttattaatgggcttcctttagttacctttgaattaaagaacccagcaaatgcgaatgtaggtattcaacaagcttttgcccaattttctacttataaagaagaaatatcttcttatatgcaatataacgaaattttaattgtttctgatggaattaatgcgcgagctgggtcattaacagcgggaattgatcgctttatgcggtggcgcgagccgaaaaatgtagatattgacgattcaatgatggaattagaagtattgataaaatacatgcttaccccatctgatttattaaacatcattcagaattttattctttttgaaagtgatggagacaagacaatcaagattttagcagcatatcatcaatactatatggttaataaagctgtaaaaagaacatcaaaagtattggctgaccctgatgacaaacgaattggtgttgtttggcataccactggttctggtaaatcattgtcgatggtcttttattctggaatagtagctcgtaaacttggtaatccaactattttagtaattaatgatcgtaatgatttagatgatcagttatttggtacttttgcggctgctcatgaatatctacaacaaaaccctgatcacgctgaatcacgaggagaagttcgtaaatacatgagtaagaattctggcgggattgtttttagtacaattcaaaaattctcaccaaactttgacgcaggtgaagaacatatgcctatacttacaaaccgttctaacgttatcgtaatggttgatgaagctcatcggtctcaatatggaatgcaagcaaaactaaccgataatggtattcgttatggatatgctaaatatttgcgtgaggctcttcctaacgcctcgtttattggttttacaggaacaccaataaatactgaagataaatctaccgtggcaatgtttggaaattacattgatgtttatgatattactcaagcagttaatgatcatgccacggtccggatttattatgaaagtcacgttttcccattaaagcttaaggacaatgcaattgatgaatatcaaaagttaattaaagaagctggtattaatgacgatcctaatcttagagaaactgagcgacggaatcgggcatttactagattagaggcccttgccggtgcaaaaccacggttagaaaaaatagcccaacactttgttcatcattttgaatcacgacaaaaggaagaatttggtaagtcgatgattgttgaaatgtcacgacaaaatgcagtaaagctatataatgaaattgcaaaattacgtcctgagtggataaatgatgatattcataagggaaaaatcaaagttattatgacgtctaatgcttctgatggcccagaatttgctaaatttaagacaagcaaacaagaccgatttacgttacaacaacggatgaaagataacgatgacgaattacaaattgtaatagttgttgatatgtggctaactggatttgatgttcctagcatgaataccatgtacattgacaagccaatgcaaggacataatcttatccaggcaattgctcgtgttaatcgagtatttaagaataaagatagtgggttaattgtcgattacattgggattgctgatgctcttcgttttgccttaaatgtatacacaaaagatgaccaaggaaaagttggaattaatgttgatcgtgcactaatgcttctaaaagagaaatatgacattattaaagaagatttcctatatgggattgattactcagaatttgattctgatgatagccaaactcgtcagaaggcagttactcgtgttgtaaatgaattagctgcagaggacgatgaaacaaaacaaaaattctttgatgtagtaacagaacttcaaaaagcttatgcattagtttcaacacagccggaagcccaagatttaagtgcggagatagcattctttaaaacggttaaagtattcttaactaagcttgaggctcctgacgatccagatgatagtaaagagattcatagttctgttgattatcgaatgcaacaactattagatcaatcaattatttcagagccgaacgttgacatttatcgtgacctaggattagaacgccctaacttagatttaatctcagaacaatttcttgaaaaagtaaatgaaattactgagaaagatctagcaattactcttttagagaaactattaaaagggcaagtaaaagcctaccaaaaaacgaatattgttaaaggcaagaagtttgaggaattacttcaagagtcaattgatgattacaataggcggggaattaccagtgaaattgtaattagaaagttaattgatatggctaaggaaattaataaagaacaacaagaaggtaagaatctgggactttcaaaagaagaagttgccttttatgatgctttagctgatcatgagaaagctgttcaagaattaggagaagaaaagttacatcttattgctgctgaattagtaaagactgtaaagcaacaatcaggggttgattgggagcggcgcagcaatgttcgtgctaaaatgcgtgttgcagttaaacatctattacgtaagtatggttatccacctgatattgctccagatgccattaagaccgtagtaaagcaagctgaacaaatggcttctcaagagagctaattattaaagtaaaaagactaattgctgttacaacaaccagtctttttaccactcaattattttcggctattaatatctttttgcaacttcaagaaataattgtcagagacatgaaacacttgtcctaactgttgcgaaatatccgcatcaattactaatttattatgcagaagatggtcaatttgctctaaagaaatagtggttttctttgataaagttactggtgatatatctagtggaatcataaattcttcttgtaaaatttcaccaatagttggcagtggaatttttgtcattttactatctcccaagttcaaaaattaatctgttttaattatagcttaaattaaaacactactacttataaattctttaaacctgaaaccgtttccttacattatcgcccaaatgcgttataattaacttaactgatcaacaaaggggcgattagatatgaagtgtccatgtcataacttatcaaagaaccaaaagattgttttattaacccttgtcgcaggagccttaatttggccaatgtacttgctatataagctggcaaagaaaaaataatttttatacgaagaatcacttgcaggtggttctttttttcatgatataatttgaaagttaactaaaaaggaggcgagtcacatgttagatatcctggattacacgaaacaagaattgatttctgatgccgatttttggcaattcgcgggtgaacatcttgaaaaaccgactgaatttaggggcgtttcatttgtttcttcaattaagtttattgaggagcaactattaccgcgctatgataaggtcactttgatcctcggcttaagtgataatggaaaagaatcaattggcaaacggatgaggcagttaaatgaccggactgaatttgtcaattatggttatgaacaccctgatagtgaatttacaaagcgaattttagatggcagcttgcgacttttattcacaaaacaagaattaattcataccaaaatgtacttaatgacaagtgacgaccggtatctctcatttgccggttcaatgaatttaaccgaagcagcaattcatcataatttagaacaactcgacagtgactatggaatgcagacggatccgctttatcaatgccatgtccagatgttcaatgataaccttcaccatgcgactgcctatctggacgcaaagaaaatggccgggttcattaaggcgaaaaataaagagcaacttcagattaatgtctataccgatacagtgaatatggtgaaaaacaaggataacggtgaccaggatgcggtgattatcccggcagaagaagtaaaagaatataaggatcagtatagttctgacgaggaattaaagaaactatcagctccagaaaaattgagtgtcgcccaaactgtcaagctctttggcaatgctggctataagaaacgcaatctcgaaaatatcgggaaagaactctacagccttactcaagtagttaaacatgtgtctcgaaacgatgataactcaggaaagattacccgtgaagaagatctctatcctaagccagtcttgttttataacaatggtcaattatttgaagcgccccgtgttggcgataatgtaaagtcggaattaataacatcgaatttaactggtgcccgtctccgtgaacagcttcaattatttagcgatattgcgcatgagtacgataattacaaagaagtcggtgaggggtggcaagcatgtgatttcatgtgtttcctatttgaagctccctggctatggaaaatccgtaatatgtatgaattatcgccaagcagtaaatcacgcgaagatgttcccctcggagtagccttgattggtcaaggacgaactgggaaatcgacgttgggaaagcggctagcagccaagctaacaggaagtggtaacttccttgatggcggtgtttttgatgctaaaaattatgcattaggaaagtccaatatcaatatgactattacaacggttttaagcgattatatgtatagtgctgggcccgttaatccgatgatgattgatgatattagccctgacttaacaacacggccatattttgatcgcttcattaaagaaattactaacaatcgtagtttaactcagccactcccatcatttatttttacgatgaatcgtcgtgagggtgacagtaaatcgcaattttcccttaaaccggaaattatgcgtcgtttatggtacctcagctttgaatcaacttttgccggggatgaagatgaacgagaagctaagttaaatgacttgcttgagcgcgctaacgatcaactttatcgttattgccaagttgaacttgcgaaatttttcaatgatgtgtcaccagagacagaacaaaagattgaaagggattacctttatccaatcaaatatgtcttgaaacaagcgatggaccaatttgggatgtttgagcttgttaaagactactttgaagataattatgattactcactttttgtcgggcgaaatgattggacaatgctgattaaccaggcggaagtcggtgctgatctaacgtttattcaacaggatggtcagttaaaagcgcaaattaataagcagttgtttaataaggtttcagatagtacggcgcgaaataatgggtcaatgatgatggaacggtacttccaatatctgccgcgaaagtatcgaattagttatcaatatactagtaccggttttattgtcgatgttgctaattttgatcggtggcttaacagtgatacccttcagcaaaagtataatagcagcgaggtagcccgggatgctcaaaaggtaaatactgatgcaaaaatgactgaattgcttacccggttaacagaggcacaagaaaagcaagcgcatcgccacgggatatttagctggcttaaaaagaaataaggtgaacttatgaaacatatttggaaacttaacctatttcaaaagataattgtttggttatttataattgctttaattacctggcccatatatttttacgtaaaggcaaaatggggctaaaataagagtgtaggtagtgataggtttttgaacaaaggagtagattcttatgaagaaaaataaaactgaaaacaaaactacacaacctaagaagcattcaaagaagaagtttactattttagcccttttagctggcgctattgctttaccaatttatttagtaaagaaagcgtaaaattataacttatattgaaaaggatcacgattaggtggtccttttattatgtctttttaaattttattgatcaacattaaacggaataatgttcatttgttataattaatgtaaccgctatactaatgattcacaaagaaaggatgccgataacaaatgaccaaaaagataattcttgactgtgatcccggacatgatgatgcattggcattaacgatggccgttgcttcaccgaagattgatgtccttgccgtaacaacttctgctggtaatcaaacaccagacaaaactttaaataatgcgatgcggatgttaactttactccatcgagaagatattccagttgctcagggaaatcaaactccgctggttgagccgcttgaaactgcaccggaagttcatggggaaacaggtttggatggtgcggaccttcctgatcccgatttcaaagttcaaccaattccagctattgagttgattgctaaaactcttcgtgaaagtgatgagaaagttaccttagtagttaccggtccaatgacaaatgcggccttattcttacgggtctatcccgatttggcgaaagaaaagattgatcagattgtcttcatgggtggggcaatgggacttggtaactggcggccatcagtcgaatttaatatttttgttgatccagaagcagctaaaattgtaatgaacttcggcctgcctctggtaatggcaccgttgaacgtgactcataaagctcagattatgaaggatgagattgagcaaatcgggcaaatcaataatccagttgcccaagctttccacggtctcctaaacttctttgaacagtaccatgaaaatcctaagtggggctttaagggtgcgccactccatgacccatgtacgattgcttggttgattgatcccaccatgttcggtactgacaaaatgaatgtagatgttgaaactcagggcgatcttacacggggagagacggtttgtgactactatcagttaactgataagtcccaaaatactgaagtcctccttgatattgatcgtgagaaattcatccaattgatcattgataccctgcaaagtttctcacagaaataaatttgctgtttacaaaaagaaagtgaagagttacactatatgtaaatttaacaatctaattttcttcggggcagggtgaaattcccaaccgacggtaacaagtacgcttggagtccgtgacccgttagcatttatgttaacggttgaaccagtgaaaatctggtaccgacagtatagtctggatgggagaagaaaactaaaaatgacacaatcagtttaaacgtaaagccccggatagcagtgatgttatccggttttatttttgccgagctgtttttttaagttaactatttaacgtcccgagagaaatcttaggacgtttttattttggaaaggatggttagagtggaagatgcttatttcatgcaaatggcaatcgctgaagcagcaaaggctggcaatgaaacttggaaaaatcctcgcgttggggcagttgttgtgaaaaatggtcaagttttagcgcgaggtcatactcacgaatacggtggaattcacgctgaacgggatgcaataggtaaacttacgccgaaacagggacagggggcaactctttatgtcacgttggaaccctgcaatcactatgggaaacaaccgccatgtagtcaggcgattattgacgcgggcatcagaagggttgtgattgcggaaacagatccgcacaagcttgtcaccgggaaaggaattgctacgcttcaacagcaaaatattattgtcaaaacgggcgtccttaaagaagcagcacaggccttaaatccgtattacgattttttctatcggtaccaacgaccatgggtaactttaaaacaagcagtgagtcttgactatcgcgtggccgcagaaaaaggtcaacgaacggcgattactaattctgctgtggcaaaaatggttcataccgagcgtggtaattttcaaggaatcttgattggaagccaaaccgccattatcgataatccaactttattaacgactagtccgacaaagtttccgccagtaaggattgttcttgaccgccggggacgtttaaaagataatccaaccttacacttgttgactgacgggcaggcacctacttggatttttacggaaaatagttcgctacaagatcagtttgctaaaagcattcaggtattttatcgccggacgtggtcaattaacgacatcttgcatgaacttggtcgacaagaaattcaatctgtttatgtagaagggggtccgactgttcatcaagcgtttttacggaaaggattgtttgaagagcttattacttatttagctccccagatgcttggcgaaaaaggggtgccagggatggagtcacctcatcaattacatttagcccatcaggaaattaaagttttagagaataatattaggattgcgggaaggaagatggaacatgtttagtggtttagtagcaggagttggtcggataacagagatcaacctacaaggagaaacaattgaactagcggttactccgcgaattgatgactttttaactaccgtccaactcggagattcaatcgcggtaaatgggacatgtttaacggtcgtagaaatcaataataatcaatttacgacaactctaatgccgcaaacgtttgaaaagacaacgttcaaaaacttggaaaaagggtcccttgtaaatcttgaacgttcattgcaagttggcgcacggctagaaggtcatattgtaacggggcatgttgacgaactatcacgagttttaaagcggactgtcaatgaaaatgctattgaagtacaatttagtattccacaccgcctgcatggtcaagtggtagcgcaaggaagtgtcgcgattaatggcgtaagtttaaccgtgatggaaactggtaatggctggtttacagttgggctgattccgcacactcaactcgtgactaacttagatacgcttaaagtaggggatgaagttaatttagaaactgatattttaggaaaatatgttgtcgcaaacttatcaggaggcaaaaactaatggatgtaaagaaaattcaagcaacgattaagcatctgcaagaaggtggtttagcaattgtcatggatgatgcagaccgcgaagcagaaggcgatttggtggggcttgctagtaaagctacccctgaaaaagttaactttatgactaagtatgcacgtggattgatgtgtgttcccatggcaccggaagtggctgaacgactgaaattgtcacagatgactgctgataattcggatccgtttgggacagcttttacaattagtgttgatcaccattcaacgactaccggaatttcagcctttgatcgttggcgcaccattactcatcttgccgcgccaactgctaagaacgaagacttctacaagccaggccatatctttcccttggtcgccaagaaaaatggggtattagaacgcgatggtcatactgaagccgcggttgacctcgcgcgcttggctggagtggaaccagttgcttatatctgtgagattttaaaagacaatggtgaaatggcgcgatcagttgaacttcatgagaaagcagccgaatttggcttacccatcattacgatcaaagaacttcaggaataccggcaaagtttagcgagcaaaccagtagaagaggtgcatctcccgtctcagtatggtgactttcgcttacgatggtttgatgacaataatctagcgctgataaaaggagatattgatccaactactcctgtaatggttcgcttgcattcagaatgctttactggcgatgttcttggttcccttcgctgtgattgtggtcctcaacttcatgaagcaatgcgccaaattgagaagaacggcagcgggattattatttatttgcggcaagaaggacgaggaattggtttagcaaacaaattgcgagcctatcatttgcaagaacacggctatgatactgtcgaggcaaatgaaaaactaggctttgcaccagatgagcgacaatatgaccaagcaattgcgattttacatcaattagggataaccaagattaacctacttactaataatcctgataaaattgagcaactacaacttggcgatattgaaatcaatgaacgtctaccattagaaatagcgcctaataactacgacgagaattatttgatcacaaagaaaaataaatttcatcacttactgaatctggaggcttaatcatgaaagaatttactgggaaatttaatgttcaaagtgcagaaatcgggattgttgttgctgattttaacgaaactgtcactaaacaattagtgcagggagctaccgaaatgttagctaagtttgaccttgaaaacgttgatgtataccatgtgccgggagcatttgaaattccgtttatgacgaaacaattattggcaaaaaaggaatatgacggcattttgacgttaggcgctgttatcaaaggtgaaacagatcactacgatttaatttgtcaaaatgttgctagcggcgtaatgaatcttaacttaaagagcaatattccaattacatttggcatccttactaccgataacattgaacaagcaatgcaacgagcgggactcaaagcgggtaatgaaggagcgatcactgcacaaagcttactagagatgatttcgttaaatcgacaaataaattaaaaataacctccattcttggataaaaccttgaatggaggttatttgctaacgtttatttttctgaatcaaacgcttgatttcatctaactcagcctttagttggcgattttcatgttggattttgactaactgggcggaaatcttccgttcgtcttttttggcaaagaactcagtaattgtactggtaagcatcccaataaaaccaatccccaagagcatcaggacaatcgcagctgcccggccaattccggtcttaggaatcacatccccgtaaccaatcgtagtagcagttgtaattgcccaccacagggctgtttcataagagactttctccgagatacaaaacattgctgcggctaccattatgacagcaatcgtaatgtacaagtagtagagcaactcatttcgctcaaagaagacgcccagacgaccggtaaatccgactaaacgcataattcgcatgagtttaagcatctgaaaggttctaccaatttgcccaattcggaagagaaagaaaaggctgctggcaggaatgattgatagaaggtcaaagatgttatctttcacaaattcgcgtttatttggtgaaataatcaggcggataacgtaatcagtaaagaagaccaaccaaatcccattgtcaatcatattgtaagggtaggtgtcaatattgattcgcttggcataatatgcgatcagcattccaatcgaaataacggctaagatagccataataatttggtagacaatgtaggtaaacttcttatgcacgatttttctcctgcccatagatttaattttatcttaagcgtctcttgaaagggatgcaaggattattctgctttacttgcgcttccgttcccatccgatcgtaatgattccggcaaaaatggtccagcctaggccaatcaaactgagtaatacgcctaatttgattcccggcaactcgtagctaaaggtaacatggtgagttccagcaggtaagtatactcctaagaaagcctggtttgttcgtaaagtggttgcctttttaccattaactttcactgaccagccagtagaataaggaatcgaagaagtgaggacgccaggacgagtcgttttaatcattccttgaacttggttacgtttgaatttaacgttctctaggcgatggcgctgcaatgttttaacttcacgataatagttattatctagtttttctgctactacccggtacttgagctcataagttccgagttttgaaggctggaaggtgagtgaagtcggcagtttaccatcataataaccaatattaagcgtcgaattagtaacatgcttgaacaaggaaagggtactttgccgcgcctgctcaatcgtagcggttccaaacttactgccgatattaagcttaaagctaatatcaggtgaaccgtttaaaacgtggtaacgccaatagcgatagtgggtatagcgctgattaataacatttccgggattaaggaccgtttccttgagatgtgcttgttcgtaggcaatctgttctttcatggagaaaggaatgcacttaatcttggaaaattcaatatgcaactcgctgccctttaatttttgctgcatttttttactttgcagctctggtaattgtaattgataagtttcttcactatcggtataggtcagtttagccgggttaaccttattcaagcggttagaaactaactcgcttttaaggggatagacatgcgtcttgagcttagcggctttcattcctcggagcttttcttgcttatcaaccagaacaccggtagctaaaacgcgttctttttcagttggtgagagtgattgataatcttttttcttaatgtagttatcttgccagtaaagtaatgggaaggcatagtttgttttataccgcatcgtttgcgtgggcacaaactcatccttgctttggggattgcttggttgcccttcatcgtaattgatgactggatcagttgctttatctaaaaagtaaccagcgggaatctttgtcgcgttatcaccattgctttgaacaaagagatatttgacgccaaagaaattattcataattgtccgatcatcggcttgccgaatggggatgttagcctgatactggttattttgcaggcttgtattaaactgtcccaaatatttattttgcagtgaatagtaagaatcaatgttatgcaatccagaagtaaggtcattatcaaggttagggccgtcaataatcttattttggctaattgttgaaacgcggtaaaaagaattgttcttcaaatcctgatcaaggttaccgtaacggttactggtaattgcctgatactctccccggctcaacatactactagagaaatcaccattataagggaaagccgcgtaaattgcgttcaccccggcgttaagcattgtaatcgctagtaaccactggtaaggatgagcaagtttgtttaagtgaatcaaccagatgaccattagggagccgattaagaaaataaccggcataaaaatatcattttcattgtcaaagaagaaggttgcgatcaagacaatgaggtaaatccccgttgcccaacttaggaccgccattgtcttttgatcaagcatcggaatgttctctgctagaatacagacggtcattgctaatggaaggtaaatcaagagcgtccaacggttagacgctgacatcattccgttgaagaaagcgccgactgctggaattagcagcatgatgagcgctagaccaaggctgatcgttagcaagggatactttcgcggacgggaataaatgtaaacaagggcgataaaaccaattgaaacgatccctaacgcagaccagaacatgaaataccattgaccaccgttaatcagtgatttaggcaaaaagaggtagtagtaaagaggataggtttttaaaccattagcaaataatgatccagtccgggttgaatttgtgaccgcaataatttcgggaacaagcaaaactgctgataagaggacactagtaattgttgcaaaagcaagtttaagcaaggctttcccataattaagcgtgcgacgataatgtgttcctacgcgaagaacaagatagaggaatgaaccaattcctaaaacataagcaaggtaatagttgcttactagcatccatgtaaaggcaccagcaagcggccagggcgatccttcttgtaatatccgttcaatctgaaccacaattaacggaaagataataaatggcgtggtaaagaagggctgggcgatacaggcatagagtaaaaacgaattgaccaggtaggttgttgcccccatcaaaatgacgctattgcgaaacttaaagtgttgagcgaaatagacgaaagcgaggccaacacaatacatccggataatattaattacctggtaggcgagggtaatctttgcggcgggaaaaagcagtgcaagataagagaaaatatccccaattgtatagtaagaatatacttgaaaggtatcactgcctagccccatttgccatgaccagaagtttaggcggagatggtggaagaagctaaccagtgcttctcgatactttgctagtaaaggtaaatgctggttgagagcatctttactgagaataaaagtatgaccagtaactaaatatgtcccgaaaatacataaggctaagaagatgaataaaatagtgtattcaccgtatagtctttttaccggtcgttttttaaatgagaaatccataattcctccttggattaacaatcattttttaggatatctctaatattttaacaaaaaaatattaagagtgacgttcttaattttagcggacattcttagaatttgggtggtaagttctaaaatgatcaattacaataaaaaagatctttatattaaaggggtagttttatggaaaatataggtaactttacagtagcaaaacgatggggatcttttttgctactatatttaggatatatgattctatttgctgaccgaacagtgatgaatatttcccttgcttacatcggtaaagactttcatgttggggcagcagcattaggggcaaccgccagtgcgtttttcttagggtatactttaatgcagatacctggcggatacttaactgataagtttggcagtaaactgatggtgattatttccctgtttgcctggtcgttgatgacgatggtgactggctgggcgtggtcccttgctgccttgattgcgattcgatttctatttgggattgcagaaggaccatatccagcagcagccttaaaacgaatttctgaaaattatgataagagtgagaaatcacaggcaacttctgccttaatttcatcgaattatgctggggcagcagtagcaccactaattattgtgccaattattgctagcaatggttggcgaaatgcctttgtttggcttggggttggcgggtttattattttgcttgcctattacctggtagaacggccaattaatagcagccaagaaaatgggcaggctcgtcccaagattgaatggaaaaagattgaccaccgtgtctgggcttttgtagtaattggacttgccctgaatatcattactaaagggcttgaaacctggatgccagtttatttcttacaagaacaaggaattaatttgaagaacttggcatggttagtaccattaccagttatttctggaggcattgcagcatttatttctggctttgtgatggtgcatttgtttaagaagcatgaacggtggatgattagtattgcttcattcctgactctggttttcatgtttggtctctttaagtcaacttcattagtaggcgttgtgatctttgatgtcttgatctatttcgttaaatcattggcatttaccggtatctttagtttcattgcacagattttatcggagaaaacttatggatcatcaattgggattgttaactttggtgggcaacttggtggttttgttggtccgctcttaattgggtggattgtccaagcagccggctcatattcagctgctttcttcggccttgttatcagtgcattagttgcagtgattgcatgtttatttattaggaaagcataaaaaataaggtgttgagagaaaataaaaagctttctctcagcaccttattttttgctttataagtccttacttcattaatacttttaatagcttgccgtggcaacgatgcaaggcactttggacgctccgtttagagcaatcaagggtaccagcaatctcagttatcgaataaccagtatggagatacactagtacttttcgttcaaatgtagaacagtggcaaagtaaacggtcaagactctgccggcaataaataatgtcatcaggggaatgatgtaaaaagtcggtaagtgtttcagcaaaatcatcgcttaatgcgtaaagacagcctgctgggatccgtttgtgagcctgagtttgtcgttgaatatcacgaatccggttggttaagcattccttaaaaaagcagctaaacatgcgcggaccttgattattgtataaacgaataacttctagcatcacaacacgggcttcctgttcccaatctgccaattcaaggccgctaatattatatcgttgccacagtcggcgaacgagcggccaataacggcgaaataactcttcgaagtccttattgcttccgcgacgggtattgttaatcaacttaaggtacttttcttcatcttcttcattgaagcgcatatcaaaaatgctctcctttaaaactataatttacgcgacatgcttcccatcatagtgtttgtcctatttatttttcttctccccaaataggtaaactgacgacctaaaagaagggattcattccttaattcaggcaagataaaacggtttaattttatcacgcagttcgcctcgcgttggtattaatttatcaaatgtcttattttagaacaataacagaatttgtataatcagaacgattaatcgaacgttaaagcgaaaaaagatagtaacaaaggtgcataaccattttttataattccgaataattttattttcaaatactaattaaagaattgatcagaaatttacgggtgaggttggttgattagggtaactatactggtactagtacattggtcattacaatggatatcgacttgccaggtttggattcgtcggccacatttaatcggcgttgcaatggcccttaattcaccattcgataccgcaatgaggtgctctgtggtaatattaactccgagagctatttgatcttgttgacgatcagctaaccattgattagcacctaaggaagctgcggtttcagcgaggactgcatttattccaccatgaacgattccataaggttgcttgagtttatcacttactttaacagtgataacgcacttgttggctgtgactgattgagtttgaatatctaaattttctaataggttcattattattgacctcacaaaaggagtagagtagttatgacaacagttgattggcaaccggttaaagattattctgaaattatttttgaacgagcgggaaagattgcaaaaattacaatgaatcgtccagaaaagatgaacgcctttacccccgttacaattcaagaaatgatcgacgcgtttaccatctgtcgtgatgatagcacaattggggtgattatcctaaccggtgccggtgataaggctttctcatctggtggtgaccaaggagttcgaggtaacggcggatatgtcggccccgataagattgctcgtctcaatgtccttgacttgcagcatttaatccggattatccctaaaccagtcattgcgatggtaaaaggctggtcagttggtggcggaaatatcttgcaacttgtctgtgacttaacaattgctgctgacaatgctaaatttgggcaaactggtcccaaggtcggcagttttgatgctggctatggatctggttaccttgcccgcgtgatcggtcacaaacgggcaaaggaagtctggttcttaaaccacttctacagtgccgaagaagcctaccagatgaactggattaataaagttgtgccattagaccaagttgaatcagttaccttggactggtgtaacgaaattttgaagaagtcaccaacggcattacggtttattaaggctgctatgaatgctgatactgatggactagctggcctccaacaactcggtggtgatgcgacgatgctcttctacaccactgatgaaggtaaagaagggcgcgatgcctttaacgaaaaacgggaccctgattttgaccagttccctaaattcccataaaaagaggcaatttaaatggaaacacaaaactggctattaaagcaagcggcaactcagccgaaccagattgcaattgatgacggtaatgagcgcctatcatttgctgaattaaaaaaacaagtagaggtagttgtgggaaaaattgaccaccttaatcctggttcgcgggtaggcctcctagctactaatactttgatgagctataaattagcattagcaatcatgtgtagtggccgcacgattgtctggttgaactggcggcttgctggtgaagagcttgaacgacagattaaagatagtggccttcagttgtgtttggttgaaaattctctctggcgatcaggaatgacgaatccttttaagtcttacagtgcattcttgataacaaatgccgatccaggagagttgattccggtatttaaatcagactgggtagccagcatcatgtatacttctgggacgaccggtaagcctaaaggagttttgcaaactttcggcaaccatttttattcagcagtctcttctgcattgaatttaggtttatcgtccgcggataagtggttatgtgtagcaccgatcttccatattagtggtttttcgattattatgcggggattaatttacgggatgaccgttcgcttggtcgagaagttccgagccgaagaaattgaacggattttagcaaatgaaacggtcactattatgtcggttgtgccttttatgctgaaaaagctcattcagcagcaaaataagactaatacgcactataattcagcatttcgttgtatgttacttgggggcggaacgattgatcgagaaacgctcgagatatgcttacaacggtcaattcctgttgttcaatgctatggaatgacggaaacatgttcccaaattgttgcattacggtcagtcgatgcactcctaaaattaggatcagttggacagccactattctcaacccaactaaaacttagtaaagatggtgaaattctgctgaaaacaccgactttaactccgggctatcttaacctgcctgataagttgccttctaaaatgattgacggttggtaccggacaggagatattggtcacctggacaaagaaggctacctctatatcgatggtcgcgcagatgaaatgttgatctcgggcggagaaaatatttttccccaagaagttgagcaggtctaccaacgttacccacaaattaatgaagtggcagtcgttggtcaaaatgattctgtctggggacaagtaccagttgcctttgtcgtcagtgatcgtcgtctttctacaaccaagctaatgaattatggttatgaacatctggcacgctataaggttcctcaacactatattttcgtttcggaattgccgaaaaacgcgagtggcaagattcgccggtttatgttacgagaaaaattgaataataagtaaaaaaacgaggctgagagaaagcaaaagttttctcccagccttaactgttttcatgaacaatatttttataattgctttttattctttgccagctttttgatttcacaatcgtagtcacaagctgcacatttaccttgcttgcctcgttgaaaagtcttaacaaggaggtaaaaggctaatgcaataattgcagcaataataataacgttaataattaatctcattttaaatcacccaataaacaatcgaccaacttgaaagataataaatgcaatcccataagcaacgactaaactggatgcaacagaataaagcatccactttgtagaaccagtttcttgcttaatagttgctaacgttgcgaaacatggtgcatataagagaataaagactagtaacgtataagcagaaagtggagtcataaactgaccaagggaagcgataaggaatgctttactgcttgtatggaacattaccatcatactagaagtaataacctctttggcaaggatccctgtaaacaaagcactaattggctgccactggtcaataccaattggcttaaagatcggaacaaggatgtgtccaaggccggctgcaaagctattagccgaattagtaacaaaaccactagggccaaaacttgataatatccagattaaaacagttccggcaaaaataattgtcccagcttttttaataaatcccttacccttatcccatgtaccgtgccaaattacatcaagacggggaaggtgatagtgcggaagttcaactacaaacactgagctttcttttactttaaagattacttgatagaattttgccattgctaaagccacgacaatccctaagaagtagactgataaaacaatcagggcttggtgacgtgggaagaaggcggcaacgaataagctataaatcggtaggcgggctgaacaactcataaacggcatgattaaggtagtgatcagtcgttctttaggctgttcaattgttcgcgcggccatgattcccgtaacgttacaaccaaaaccgataattaatggaataaaggatttaccgtttaaaccaatcatctgcataacccggtctgttactaaggctgcccgcgccatgtaaccagagtcctcaagcagagaaatacaggcaaagagcatgaaaatttgcggaataaaggctaaaactcctccaactccggcaataataccgttaacgactagcgaccgtaatgcgggaattgcccctagactagctaaggtttggtcggcagtagttgaaactggacctgatataaactgatcaagcatatcggaaagtggggtaccaacccaatcaaaggacagcttaaacattacaaagaaaattaagacaaaaattggtaggccaagaatcggattggtaacgattttgtcgatgcgacttgttagctcaacttgaccaccgttactaagtggatgccgcgtctgatcaagcgtgtcctcaataaagtgtaaccggacttcaaaaatctggtcagcaaatttttgcgcgtcataatatttttgttgcgaaagcaggggagttaaacctttttcctgggcaaatttgcggattactttattcttacttatgaattgaatcgctaaccaacgcgcaacttggggcgcaaaagaataatcgcttgccagtgctgtacttgcctgcctgattgcttgtttgatcatcgggggataatctaagtctagttgggtaggatggagcgaattacaattgatagtttcttttcgtaattgatcaattccttggtgcccgcgagcatttgttgtcattactttacaaccgagccttttttcaagcaggtcaaggtcgtagtcgtaccctgatcggcggagatcatcaatcatgttaagaaccaatacaacaggatagccgagttccaatacctcgattgttaacaaaaagtttcgttttaactgactagcatttgtaatatttaagaccatattaggttggttatgcattaagtagttagttactactgcttcgtcttttgtcaaaggatcgagtgaatatacaccaggtaaatcgatgataacaatatctgttcccttaagcgttccttgtttcttttcaactgtgactcctgtccaattaccaacataggcgtatttatcagtgagtgtgttaaacagggtcgttttgccagtattagggtttccaatcagcgcaactgttgtcatctcactttgcctccgtaagcaatgcgaaaacggtgtaccgcaaaccgattcgttggtggtcattttcgattatcactgggccatgaaaggggtatttttgaactactttaatcggacacccttcacacaagcccatatcatgtagtcgggcggcagtggctgtatttaaacagtcaaatgagtgaagaatataattttgttgaatcattatcgccacctaccttatcgaatattccaaaattatataaacactatattatatcttcattatacacttaaatcatttgttgagaaagcgcttaaaataaattgagatgaatagttttatttttttattattcggatataataagaatgtaaagaatttattgatatttatggaatatttaccgagaatattttggaatatttcggtcaggaggatgaattttatggcaacactagaaataaaggatcttcacgtttcagttaaagatgaagaaagcaaagaagaaaaggagatccttaaaggggttaacctcaaaatgaagactggagaaattcatgcaattatgggaccaaatggaactggtaagtctactctttctcaaacccatcatgggtcaccctaactatcatgttacgcaaggagatatccttcttgatggggagagcattgttgacatgccggtcgatgaacgggcacgaaaaggtctttttcttgcaatgcaatatcccgctgaaattcaaggggttactaatgctgaattccttcgagcagcgatcaatgctcgtcgccctgaagatgatcagatttcagtaatggactttattaagaaactcgacaagaacttggaattgcttgatatgagtcaatccatgactgaacgttatcttaatgagggattctctggtggtgaaaagaagcggaatgagattttgcagcttttaatgattgaacctagttttgcgattcttgatgaaattgactctggacttgatattgatgcccttaaggtggtttcaaagggcgttaactcaatgcggggcgacaactttggttcattaattattacccactatcaacgccttttgaactacatcgttcccgatacggttcacgtaatgatgggtggtcgaattgtaaaaactggtggccctgatcttgccaagaaacttgaagatgaaggttacgctggcttacgtgacgaattaggtcttgatatcaaacttgtagatgatgaagactaggaggcagtttgatgacagaattaaactcagcaaaagaacaaataattgctgctagtaaggcaaataatgaaccccagcaattgattaatcgccggcttagtgctcgggagttgatggaaaagctccgtttgccacgaatgcaacggttcgattttcgaacttggccccttattgcggagcggccattgaaatgggttgaatcagacgccgacttagttgaaaaaccagtcacggatgatgaagtaattaaggtaactcagtttgggcaaactttgctccatgttaacttgccacaaaagcttcaagatcagggggttattctcacagatatctttactgctgcgcgcgaatatcctgaacttttcaataagtacttcatgactgccattaaccccgaagaaaacctcttaactgcttatcatcttgcctaccttaatgccggtttattcctctatattccaaaaaacattgaaattgaaaagccaattgaggctgagattattcaggacagcacgcaagatgagcccctgatttcgcatattctagtaattgctgatcgtggcagccgaattaagtttatccaacaccttacaacggttggtgaccatgagaatgccgctaatatgatgattgaattaatggcgcaggaaaatagtgaaattgacttttcttccttagatgaatttggtcctcatacccatacttactttaagcggcgtgccgatattggcaaggatgcgcacgttgaatgggcagtcggcttgatgaacgatggtgccacagttggtgacatggattccgaattgctaggtgatgggggttatgctaattcaaagatgattgccgtaactactcgtgaccaagaagttggcgtcaacaaccgcgttactaatcacggcaagcatactaccggattgataaatcagcgaggtgttattcttgaaaagtctgaattgatttttaatggaattgggcaaattattcatggtgctcacggggcaaaggcagaccaacaaaaccgggtattgattatgtccgatcaagcacgaggggatgccaacccaattctgttaattgacgaaaatgatgttgaagcaggacatgcggctagtgttggcccggttgatcaacaacaaatgtattacttaatgagtcgggggattccgcgcgcacaagcagaacgaatggttattcgaggattcttaggagcagtcttgagtgcaatcccagcagcggacgtacggaataagttaattacgattcttgaaaggaagctcgccgatggacaacaatacaaatgattatttagccgactttccagcacttaatcagcgggtcaatgatgaacgcttagcctaccttgataatgctgcgacagttcagcgtccgcgtcaggtaattcaggcacttgttaacttttatgaacaagacaatgcaaatgttcatcgaggggttcatacactagcagaacgtgcaaccaaggattatgaagaagcacgaaaaaaagtgcaaaagtttattaatgcgccgagtgctaaggagattatctttaccaaggggtgtacggatgggttgaatctcgtcgctgcaacctatggcgaacaaaatattcaacctggtgatgagattgttatttcaataatggaacaccatagtaaccttattccttggcaacaattagctaagaaaaagggtgctaccctgaaatatattgaattaactccagatggcgaacttgatcttgcagatgctagaaagaaaattaccgataagacaaagattgtggcagtagcccatgctagtaatgtattaggaacagtgacgcccttgaaagaattagcaacgattgcgcaccagcatggggcaattattgtcggtgatggcgcgcaagcagttccccatatgcctgtcgatgtacaagatcttgatgttgacttttacgctttctctggtcataagatgatgagtccaatgggaataggggttttgtacggaaaagagaatttattacgagcgatgcctccttaccaatacggtggggaaatgattaatgatgttcaccgagatgagagtacatgggctgatattccgtttaaatttgaagcgggaacccaaaatattgccggggcagtaggtcttggagcctcaattgattatttaaatagcattggaatggataggattgtgcaaaaggaacaggaacttgttaactatgttttgcctaagttaattgctattccagacgttgaagtttatggtccgcaatcaccggcaaagcatactggggtaattgcctttaacatcaaaggccttcatccccatgatgttgctacggcccttgatatggatggggtagcagtccgcgccggtcaccattgtgcgcagccactcatggaagacctgggagtaacggcaaccgcgcgtgccagtttttatttttacaatactaaagaaaatgctgatcaattaattaatgcaatcaaagaaacaaaggagttctttaacattgggactatctaagttaaatggtttatatcgtgaagtgattctcgattatgccgatcatccacataataagggagaattagcaactactacgaatgcaatgacccttcataatcctacttgtggagatacgattaatcttcaggtcgaagtagaagataacaagatcaaaaatattgcctatactggtgatggttgtaccattagtcaagcatcagcaagtatgatgaccgatgctgttaaaggaaaaacaactgaagaagcccttgcgatggcaaagactttttctgatatggcaattggcaaagaacattcagaagctgacttggatcaactaggagatgcccggatccttaccagtattatggaattcccagctcgaataaaatgtgccacgctttcatggtgggcattacaacgagcactgttgaaggatagcgaggaggaagaaaataatgagtaatgatgcagctagcattataaataataatgaccagtacgaatacggctttcacgataacgttgagccggaatactcaactgggagagggttaacagaagaaactgtccgcgaaatttcagctgctaagcatgaacctaaatggatgctagattaccggcttaaagcctacaagatttataaagaattgccgatgccaaaatttgggccggatttatcagagttagaccttaagaacatgctttactaccaaaaaatgactgataaaaagtttcgcgactgggatgatgtgcccgaagatttaaaacggacttttgatcgcttaggagttccggaagcagagcgaaaataccttgccggttcatctgctcaatatgaatccgaagttgtttatcacaatatgaaaaatgagtttgaaaagctggggattatttttactgatacggatacggccttaaaagaatacccggaattatttaaaaaatggtttggtaaattagttcaaccaactgataataaatttgcggccctaaatgcagcagtatggtcgggtggttcatttatttatgtaccaaagggcgttaagacaaagacgccaattcaatcttacttccggcttaatgcggaaaattcaggacaatttgagcggaccttgattattgttgatgaaggggcaagtgttgattatgttgaaggatgtactgctcctaattactcttctgatagtctccatgccgcggttgttgaagttaacgtctgcaaggatgcttactgccgctacacaactattcagaactggtctgataatgtttatagtctagaaacaaaacgggccgcagcggcagaaaatgcaaccatggaatgggttgatgggaaccttggctcaaaagtcacgatgaagtacccaagtgtctaccttaatggtgagggtgcacggggaaccatgctttccatcgcagttgccagcaacggaatccaccaagattcaggggcacgaatgatccacaatgctaaaaatacatctagttcaattgtttcaaaatcgattgctaagacagggggctcaactgattaccgcggaacagtccgctttggtaagcactctgatggctccaaagcccacgttgaatgtgatacgatcattatggatgatcaatcatcctcagatacgattccatataatgaaattgacaatgctcatgtcgcaatggaacatgaagctaaagtatctaagatttctgaagaacaactttactatctcatgagcagggggatttcagaagcaaaggcaactgaaatgattattatgggcttcgtggaaccatttacgaagcaattgccaatggaatatgcagttgaattgaatcgtttgatcagttttgagatggaaggttcaattggttaattgaattaacaaataagtttggaggaacgtttatggctgacgaaaaagatacccccttttccccaattgaaaataaagtgatggatgcgttggaagaagttattgacccagaattgggaattgacctcgttaaccttggccttatttatgatgttaaggttgatgataatggtgaatgtacggtcacaatgactttaacgacaatgggctgtccattaggcgatattttgaaccgcgacattaccaaggcagttacttctgttgaaggtgtaactaaatgtaatattaatcttgtgtgggaaccggtttgggatttgtcaagaatgagcaggtttgctaaaattgcattaggaattcacggctagatataggaggtcagacatggatattaaacgctttgtttatcaacgaaagagacttggctattcacaagttgccttaagcaaggggatttgtacccagtcgaccttaagtaagtttgaaagcaatggtcaagtaccatcactcacgattctggcgcagctttgtgatcggctagggctaacgattgatgatttaagtaaggacaatacatcctcaattcgttatatgagaagcctgcttgaccagattgaattggctttaatgattgaacactttcctcaggcagttagtaaccttaagaagattcggcttgaagatttaaaatctccacaagatcggatgcaatattattatttaaaagggatgatttatactttaactaataataacgcgtcgacaagtctctttaactttactaagattttagatgaactggatgagcaacatcggacgatcttttcaccattagcatatttaggatcagggatcttatatgcgcggcaaaattcaatggaacatgctgatttctttttctcaaaggttatttcatttttaagatcaaaggctgatgaagacttagcaggtgttgatcggaattattatctacggattgtaacaatgatgtactacgctgccgagtaccattcattaaataagcggttagaggttagtaaccaagttttggaggctacgacaaagatctgtgctagcaatcacgttacttatttcttaccacgtatcaaattactagaagcaaataatgcaattgagttaggagaaagctcgaaaaaaatacgccggcttttaactgaagcagaggtatttgctcgcttcaataaaaacaatgttgttgaagttcaagtagctgccctgttaaataactttgataagacgattagtaataaatgaaaataatgggagtggggtagaagtcagaggtgacttctaccccactcccatttataagtccactaatcgatgtttaactgcatagtggagaagttctgcgtgtgaagcaaggtttaatttttgcataatctttgtcttatgggcttcaacagttttaggggatataaacatcttaggtagcaatttctttgttagtatatccgagaacaattaacggtaagatttcttgctcacgtttcgaaagagcaacgtaatttcctaaatcgaagtgcggagaaccgcctttgataactaataaatctttcttcgttaccataatattattgtctaagtatttttcaccattaatagcgtgtcttagggcatgaactagttcttttggagaggagcttttaaggatatagctatttgcgccattataaattgcctgattgatgtattgaggttcattacgagaagaaaaaataataattttggtgttagggaaatgttcatgaattcttttgattgtgatcagaccattttcaccaggtggcatcgctaaatccataataatgatatcaatgtcaccttgttcagcccgcaatgaggcatctattccggttgcttcttcagcaattactttaaaattatctagttgttcaaccagatttttaactgccattcgaatgattggataattatccgccacaagtactctatacatcaataaacctgctttcattcttaaagttatctcttcttcagtatcttctttttgctaattattatcaagatccaaaaattattttttacacttgctgaaatagtttcaataaacggctggaataattgtgaaaatttattgcagaataaaactaatgctgtaaaataaaagaggatcgttgatgacatgacaacatcaatggtccacagtagaagtatgttggcgaaagtgattgcagaatcaccttcgccttttattataccaattttttgtactaatgtaataaagattatctttttatctataaattattttatgaaaagagtgaaaagggcaagaagagcaatcaaaaagccaattttaacaattttattaagttgattgaagaaaaaataataatcatctaataattaatgcatttacggattgtttgatctagaatgtaattattagctattcttgaatcagagaaaggtgaagcattgatggcagaaaaaacatttacaacaaccgagctcgctgagttcgatggtcgaaatggacatcccgcatacgttgccgttaaaggtgttgtttacgatgtctctaacgttccgcaatggaagggtggtaaacaccatggaaaccttgcttgtcgtgacttgacttcagtaatgcctcgttctatccatctggaatcagttcttgaaggtatccctgttgttggcaaactagttgactaggaataactatgtaaaaagctaggaattggtagttttaaactatctctccctagctttttatattgtaaccttaaaataatcccgcaagtattttgccagcccattatgttcgttatcaattggggtcacatcgttagcaatactcttcagttcgggaatcgcattatgcattgcaacaccacgtcccgctgcatcaagcatttccaaatcattatgctcgtcaccaaacgcgataatattttgtcggtcaatttggtattgcttagcgatataaaacatccctgactccttatgagtgccacgatggatcagttctaagatgttgtaagggccaccccatactcgtggttcaacgaaatcgccgtatttttcattaactgccttaatgatctcttcttggtgttccggttcatatttgattgtcattgcaattggattgcttgttaagttagtcgcggttaggatttgatcatcgcgcaacttgttcggtaagaattcaggtaaatcattactagcttgattagcccatacatgatgtttattttcaacggtaattgttttaattcctagttctttccggtgggctaggagatcaagggctagctctcgtgttaattcaacatcatattctttatcccagtgttcatgtggtatatgcgttagggccccattaaagtttaccatcggggttttaatcccaatttcatcgtaaatatgtttggcaattcggtaaggacgaccggtaataatgctgacaatatgtccatcccgggcaagggcacgtaaagttataattgtctcgtttgttaatttcgattgattatttaatgttgtgccatcaagatcaagcgcaatcaagtgttgatccattaccatttcacttctctttccataaaaaattcaattataatattgtaaacaaaaacttaacgctttgccaagtattttgacttaaaaagactaaaaaatacgttacaataaagatattacgataaagaggagcgagaaattaacgtgcaattaccaaatgaatttgtcacgaaatacaaaaaactaatgggagcagaggccgatgagtttttatcagcacttgcccagtcaagttatagtggttttcgcgagaatccattaaagaacggacagccggttgcaacaattgaaaaagccacggagaaagtaccgtatgtgccgacaggatattatggtcaagtgaatggaaaatcattagaccatgttactggatgggtatatagtcaagagccgtcagcaatgtttgtaggcgaagtggttaatccccaagctggagaacgtgtgctagacttgtgtgcagctcccggaggcaaaacaacccacctcatcgctaaaatgaacaaccagggactattagttgctaatgaaattttccctaaacgggcgaagattttggcggaaaacttggaacgatggggcgcaaaaaatgcagttgtcactagtgaaagtcccgcagatttagaaaaacaatttccccaatattttgaccggattcttgttgatgcaccttgttctggagaaggaatgtttagaaaagagccggccggaattgaatattggtcaccagaataccctgctgagtgtgctaaccgtcagcaaaagatcctcgcatccgcaatgaaaatgctaaagccaggaggaacattagtatattcaacctgtacttttgcaccagaagaggatgaacaaaatatctcatggctgctcaatagctatccagacttgaaacttattccaattgaaaaggcgtccgggatggatgatggccgtccggaatgggctgatggcaatgaagaattgaaaaagacagttcgactattcccacaccatctcaagggggaaggacacttcattgctaagttagtaaatggtgaacctaagacaatagataaaaagcgcaaaaagaagaataagcggaaaaagcaatcgattgttaaaccggacaaagaacaggtcaaactctttaaccagtttgctacaagcgtttttccagactatcaaccacaccaattgattttatttggtgaccagctctatgatttgccattagaagaagacaagatcgaggggctaaatgtactccgacctggacttcacctcggcacttttaagaaaaatcgatttgaaccagcgttggcatgggctcttgccagcttaccacaggaggcaaaccgggtcattgaactaagccaggaacagtggcaccaatatgtccatggggatgtaatcaatattgatgctgaccttccgaatggttggtatttattagtatgcgaggaacatactgctggttttggaaagttggtcggtaaaacaatcaaaaacttttatcccaaggggttacgtttttaaattaggaggattatcgagatgaaggaaaaagcagccttttacgttaacggctatctcgggttactcggggcgattattatcggtttaattagtttgtggctgatgtttgttggttttacgcgtaattttctggtgattctgacaattggaattattttattcttgattgtgattctttttagtacatcattgacaattattcagccaaatgaagccaaagttttaactttttttggtaattatattggaaccattcgtgatgcaggcttatttatgacggtaccatttacaaacaaggagactgtttctctgcgtgtttgcaattttaatagtcagattttaaaggtcaatgattcaaagggtaatccagtcgaaattgcggccgttattgtttacaaagttgtcgataccgcaaaagcactcttttcggttgatgattatgagcaatttgttcaaattcaaagtgagtctgcggttcgtcatgttgctagtgaatatccatatgatagttttgaagatcaagatgcaattacccttcgcgggaatccaaccgaagtatcagaacgtttaactgctgaactgcaagaacggttaaatgtcgcgggggtcaaaattatcgaaacacggttaacgcacttagcctacgcaactgaaatagcgagtgccatgctgcaaaaacaacagtcatcggcaatcctatcagcgcgcaagataatcgttgagggtgctgtttcaattactgaagaagcgattgaacgactaagcaaggaagccaaccttgatttaacagatgagcaacgtttgcaaatcatcaataacattatggtagcaattattagtgagcggggaacacaaccagtaataaatacagggacacaaggataaatgatatatttaacaattttgatggcagagcgggttggtttaattattattctagcatttttgctagttagtgtgcccttattccgccgcctgttatttaatcaaaccattagtgccaaaattcaactaacgattcttttttctatttttgctattatggctaatatgaccggaatagagattgacgcaaataaccagttgcataacaaaatcattcttacggccatttcaacaaatgactcgattgttaatgcccgaattttaggtgtttcagttgctgggattattggtgggccatgggttggtagtttagtaggattggtagcaggagtccatcggattattcaaggtgcgcccctgcaaggttggttttatgtgcctagttcagttttgattggtgcgctttctggttttttgtatcatgatcgaaaaagttattttaaggtaatgacgccgtggcatggctttattgttggaattttgatggaaagtattcaaatgctttttatcttgctattcagtccaacgggatgggctttagttaaatatattgccttgccaatgatcttggttaattcgctagggacatcgattttcttatcaatcatttcaatgtaccttcaccaagaggaagaactgcgcgctatgcaaactcattctgtcttgcaattaacaaatgaaaccttgccttattttcgtcaaggattaaataaaagctcagcgcaacaagtagtcaaaattattaaaaaatatactaattttgatgcagtgagtatcaccgataggcaacgaatactggcacatattggagctggtgacgatcaccatatcccagggaatagactagaaacttctttatccagtaatgtgatcaaaacgggccaaataaagatcgcaaataacagtaaaatgattggttgtatcgatcccaattgtcctttagaagcagcgattgttgctcctctgcgaattgggaatgaagttatcggcacgttaaaaatgtattatactgatcaatggcatttaacaccggttgaaattcagctagcaatcggtctatgtgagatttttgctaaccaaattgcattgggtgaagcagaagtacaggcgcaattagttcgagatgctaagataaaagccttacaagcccaaataaatccgcatttcttttttaatgctattaatacgattagtgcaattttacgccgggatcaagagaaagcgcgagaacttctccttcaacttagtaattatttccgggctaacttaattggggcccgggagaccgaaattactttgggacaagagcgatcgcaagtcgatgcataccttgaactggaacaaactaggtttccacagaaatataacattacctttgatcaacaagtcgaaaatgatgtttacctgccgccatttacaattcaagtattagttgaaaatgcgcttaaacatgctttcggagcacgtaaagaccataataatgttcaaataacaataaagcagctgggagcgcggttggcaattcaagtagctgataatggagaagggattgcaccggaacttcttcctaaacttgggaaagaaccattgacatcttcaaagggaagtggaaatgcgctatataatttgaatcagcgcttaattggtctatatgatgagcgtagtgcccttcaaattacaagcagtaataagggaacaaaaattaaaatttctttaccatatcacactaaggaaggtgcagacaatgaaagtcttaatcgttgatgatgaaccgcttgctcgtgaagaacttcattatctaattcagggaaatagtgaagttacagaaatacttgaagcagatgggatttttatggcagaggaacaagtaaaaagtgaacacccagatatggttttcctagatataaagttatctgatggaaatgggatggcattagctgaaaaaataaaatcatttgataatagtcctcatattgtctttgccactgcttatgattcctatgcgttagatgcctttgaagcagatgcagttgactatattttgaagccattttctgctaaaagggtcaacgaagcaattatgcgtgtcgccaaattaatttcgccagaggatgatgctaccaaagctaagagggaattaaggcagaatccccgaatttcaattcaaaacgacgagcgaacgatcattttacagaaaaaacaaatactttacgtacaggcacagcaaggctttgtttatatctggactcttaataagcataaaatcattagtcgacagacgctcactaatatttatgaccaattaaaatctccagaatttttacagatccatcgtagttttattgtcaatttgaatggcgtaacagagcttcagcctagtttcaatcatacttatgagctgacattaattgatggcagtaaattaccggtaagtcgttcatatgttaatacaaccaaaaaagcattaggtttataaaaaaggattggtgaattgtttatcttttcaccaatctttttttagagtaaggcattttaagttaactggagggcattttaacgcaaatttaggttatttaatagtgaaaacgaatacaaattgataaaaattagtaaaatagattgtgataaatggtattaacgttaatgcctaaacatatttatcatgtttaggaggattattatgaagaaagaagaaaagaaaaaggaagcgcccattttagttcaaatgggaatctttgctgcaattttattcgtatcacaattaatctctaatctttttcctaagagtttcgttgttcctacaccattaattggaatgattttattatatattttattagcttgccatattgttaagttggaacaagttgaaaagttcggagatttcatgattagtttaattgcctttctgtttgtcccatcaggaattcaacttgctgggagccttggtttaatgaaaaaagaagggctacaagatgtaattgttattattatttcgacaattattttattagcagtaattgcttatgttggagcattctttattggggtacatcataaattattcaagactaacaagggggaaactgataatgactaatgtatttattaccaatctagcgttaccttttaccggggtattcatttcattgctggtttacttaattgggatgtggcttttcaaaattagtaatggcttcttccttttcaccccattgttagtagggatggtattagggattgtaattttggcaatctgggccaaagtcgccaattcaactactgctgcggtttacaagaaattttaccaaccgggtggaaacttaattttttggtttttgaatccagcaacaatggcatttgcgattccgctctatcgccggaatgatgtttttaagaaatattgggtcgatgtaattctcacattatttgtgggtggattcatttcattatttttgattcaaggaacagctaaattatttgctctttcccgtgtttcaaccgccgctatgcttcctcaagcagctactaccgctgttgcgatgccaattgcaaagggaatcggtggtgatcctgcggtaacagcgatggcatgtatcttaaatgcagttattatttatgcccttgccgaattcctgattaaggtctttagactaaagaaaatttctaaggtcggaactggtcttggtcttggatccgctggtcacactgttggatctgctaaggcggttcaactagggtcaattcagggagcaatggccgcagtggcagttgttatcgtttcattagcaatggacattttggttcctatttatgctcatctttttatgtaaattttaattagggagagaaaaagaagtatggcgacagaagaacatcaaaaggttgttttaattggtgatggagttgtggggtccgcttatgcttttagcgtgatccagcaaggtttagctgaggaattagttattataaataagagtaatgagcgaagcgttggggatgcactagatttggaagacgcaacgccatttactgccccagtaaaggtcaaggctggtagctatcaagattgtaaagatgctgatattattactatttgtgcaggcgctgcgcaaaagccaggtgaaacacggcttaaattagttgaacgcaacttaaagattatgaaggaaatcgttcaagaagtagttaataccggatttaatgggatcttcttaattgctgccaacccagtcgatatcttgacatatgctgttcaaaaaatttctggctttccagcacataaagttatcggatcgggaacttctcttgattcagcgcgcttaagagtagcgattggtaaaaagctggctattgatccccgcgatgttcatgttgatatgttagcggagcatggagattcagaatttgctgcttattcttgtgggacaatcggtggaacgcctttaatggattatgttttagctaatggactaacaaagcaagaactgttaaaactagaagaagaagtacgtaataaggcgtatgagattattaatcgaaaaggcgcaacatattatggagtagcgactgctttggcaagaataacgaaagcaattttatatgaccaaaatacagtattacccgtgagtgcatatttagatggtgaatatggagaaaaggatatttacctcgggacaccggctgtaattgataaagacggtattcaaaaagtagtagaattaccattagattcacgtgaacaagaggctttaattaattcagcatcagttttgcgtgaaacgacagcaaatgggatgactaaagcggggctgttgaactatctttggaaataaataaaatgactaagattgaggagtgatgttttcctcagtcttagtcatttttgtgttatttatctttttcaattaagtgtttagccaatgcaaaattaccaagagtagctgagccatttcctggaacagaagggttgacaatatattcatcgagcgatccaactggaagataatcgttccataacattgcaaattgcttccgaacccgttcaagaaaggctgggcgcgaaacacttccaccaaagataattttttgtggccgcaaaatggcagttacctgaaccgccgcttgtgcaacataatatgccatgatgtcccaaacagggtgattatcaggaacatcttcgccactaataccgagccgcgccttgaaagttggtccagctaccaatccttccaaacaatcatggtggtaagggcagataccagtaaaacttagatcagctgggtggcgttgtaagcgaacgtggcccatttcaggggtactaattccccccaataaagcgaccatcttgaattgccccagcacccacgccagttccaagggtatagtaaaccaaggccggattatcatacttatcttttaaattgacatattcaccgtaaaccgaaccattgacgtctgttgtccagtagactggaatattgagggcgtcagtcattgtgccaacaaaattgcaattttgccacttaactttaggagtatcagtaatgtaaccgtactttgcactagccggattagtatcaattggtccaaaactggcaattgacagtgcagtcagttcagggtactgcttaaaaaattcaattgaagcccctaaagtttcttcgggggtagttgtagggatgatttttttatcaatttcattaaaattttcgtcaccgacagcacagacaaacttagtaccgccagcttcaatacttcctaataacataatcaaaaacctcatttaattaaagtgaacgtttatcaatctgataaccatgtttgagtataaaccttagaaaacggtatcacaagcacaattactcactttttacttataaaacgtttcactaattcaaattaatttctgaactttcgcgccaagtggctttggcgggcaaattaatatgaatagggatttcatttggattattcagacagtgaactagtctttgaactgctattttacccattgaaagacttgctggattgatcgatgaaagggacggaactaaatattcagcaatatccgaatcattatagctaataatttgaaggtcttggggaactttaagctgatgttgcttaagggctcgatatgcgccgatagttagttggtcactagctattaaggcggcctgaaaattatctttcaaaagagtattcatgctatcaaagccatctttaggagtccacccattaagggtaatcaatggagaaatattatgaagttttgtccacatcaaataggccctagctcgaatatcttgatatgagtctgtcgtttcgccattattattcatgggatgaatatttccaccgataaaggcgattttattaagtccattttctagtaattgatcaagaacgatctgagtagcttcaaaatacgaattacggataatatcgtaagcggggagatagcgataatcgtcaattaaaacgatatggggattgtttttagctaaattagcgtagaattcttgcgtaaaaactccggcaacaattacgccatcatatttttgcgcgtcagtaaattgaaaggctttattgggaaaacgaacaaaagctttgatttgaatattttgcttggaagcttcttgaataattccatcatggacttgaatgaaataagggtcatgagcttctgtctcgagcgaatgagttgtaagtactagaattgaacgaggagttatcggcggagtaacggccctatttagatggggatggtaattatactttgctgctacttctttaattcgtgctcttgtttgtttacttactgaaaaagatgaatcattgcttaagacacgtgaaacgctggcaggagatacaccagcctcacgtgctatttttctgataccagtcatagggaaacctccttttaatcaatttctagcataacatatttttagtaaacgtttagtagtcaatggtgatggtaaattactgttataccaataatgaaagcgcttgacgaaaaataactaaacgtttattatagaatcgatttcaagaaaggggccacaacgaatgattacatttgatgaacagcaacgtgtttttcacttaaaaaataaagaaatttcctatttattttcagtagaagagggaaatatcctcagtcacctttattttggaccggcaattcgcaactaccatggtgaacgtcgatatccacgagttgatcgtggattttcagggaaccttcctgggtcgatggaccgaacttactctaaagatgatttgttgcaggagtattcaggaaacaataccggagactatcgcgtgcctgcgattattatcaaaacagaaaatggttcacgactgactgatttccgttacaagtcttataagattttaccggggaagcccaaactagctgggttacctgcatcttatgttaaaagtgataaagaagcagaaacgttggaagttattttggttgatgaaacaattggtgcgcaacttattctttcgtacactatctataacgaacggccggttattacaaggaatgcgcggttagtaaacacaagcaatcaagaattacgaattgaaaagattgcctcaatgcaactagatttaactaaacatgattatgacgttatctccgttccaggccagtatgcccttgaacgacaacctgaacggcaagaattacgtcggggaataacagaattttctagccgtcgaaattctagttctcatcatatgaacccgtttgtggccttggttgataagaataccgatgaatttcaaggaaacgctttgggagtgctccttgtttactctggtaatcaccagtttaccttggaaaaagatcagattgaccagattcgcttaataaccggaattaatgattatgactttgaatgggttcttgaaccgggaaaagattttcagacaccggaagcaatcatgggctttagtcagcagggcctaaatgggatgtcacaagtattccacaagttattacgggaccgggttgctcgcggtaagtatcaatatgcagaccgcccaattgttattaataattgggaagcgaccttctttgactttgatgataagaagttagaccaaattattgatgaagcaaagccattgggaattgaaatgtttgttcttgatgacggctggtttggccaccggaatgatgataattcatcgcttggtgattggtttgttaaccaggataagcttactggtggattaaagcgggtagcagaccggacccacgagcatggcatgaaattcggcctctggtttgagccagaaatgatttcagtcgattctaagttatataaggaacatccagactatgccttacatgaaccgaaccgtggcatgacactttctcgtaatcaattagtactagactttagccgtaaagaagtcgttgataatatttacaatcaaatgtgcttaattttagataaggtgctgcttgactatattaaatgggacttcaaccgtaatcttactgaagtcttctctagcgcagcggatgcagaccatcaaggagaaattagccaccgttatgttttaggtttatatgacttaatggagcggttagttacccgttatcctaatattttgtttgaaggctgctctggcggtggtggccgctttgatgctggtattctttactacatgccgcaaagttggccatcagatgatacagacgcggtcgaacggttaaagatccaatacggaacatctttaacttatccaatctcatctatgacggcgcatgtatcagtttcacctaaccagcaaactggtcgttctactagttttaagatgcggggcgatgttgccatgagcggggtctttggctatgaacttgacttagcagatttgactgaagaggatcggcaaatggtaaaggaacagatcaagttctacaaggctcaccgccacttaattcaatatggtgcctttattcgcttagaaagtccttttgatagcaatacagtcgcttgggaatttgtcagtcctgataagtcagaagcgctgctatttatgtttaagcagttgcatactaaccgttttgaaattaataataccaagatggcgggacttgatccaacaattgattatcatgatgagatgaccgataagacttatggtggggatgaattgatgaatgtcggtttgttccgtgacccgactcatacgggggacttcatttccgaagtgcattactttaaaggtgaatagtttaaaatgaggctgagagaaaacttttgttttctctcagcctcaactacttttatgaacaataagcaagataacgtggaaaataaccacaaggctcgagtttaagtacgaacgataatcagcccgtgccgtgctaatcatcgtcctagcttagccaaccgccttgtcgaggaggttatttcccactctcttctttactctttatcaatgcatcaatcgtccacatccaaattgcatgtcctaaaaattcagaaacatgttcttcaagtggttgatcttttgcagcaggcactgttcccattaatggcattaacttgaggtggaagaaatcccaaacagcaatcccgaatggtactccatcaccttttttgatccacggtgccaactgtccgccaatactatagagaactccaaaaccagctgagaaactaaagtgaacaacatagcttacccatggcaactgttggccggaataagtataagtagcgtgtgtgatctgtgccggaacgccaaattgttcaagcattttttgtggtggatttgtttgatctcgctctggtgtccgtggtgggagaatattttcccaaccaagtttaacaagaccagcaaccagaccagcagttatacccactgtaattgatttgccccaattaattttattcacttcaatcaccatccaaacctttagttattaaatcaattgtatcaatcttaataggaatttcaattatttaggttagcgtaagtgtcgctgacgagcatatgatagtaagtctgttcctaaaacatattcaacacgtgaaagctcggtaaatgatgagcaaccaaggagcgcgagcaagcgtttgacaatcacttgccattcaccgagcgtttggtctaatgcttcatagccttcattttgaagaatattgaggaagtaaccagcaacaccaactgcccgagcgcctaatacaccagccttgataacatcgaggggagaagtaattccgccagaggcaataatttcagttttaccacgccgaattgaatgagcttccagtagtgactcgggagttgtttgtccccagtccaataaactctcaaaattaatatcatggttacgccgattctcaatcgccgcaaagtttgtcccgccacgtccactaacattgatgaggtgaacatcatgggtttgcagtttggcgatcgtcgttttgctcattccaaagccaacctcttttacaataaccgggacttcgagctcactgacaagatactggatattatctaaccagttaaaatcacgatcaccctcaggcataattaattcttgggccgcattgatatgcagttcaagggcatttgctttcagaagggaaatagcatttatcgcttggtcaagactggcatttgcacttaaatttgcaaaaataatgccatctggattttcttcgcggattatctcaaaagacgaaaaggattgagggtcttttgaaataatactgagagatcccgttgccattgccaaatggtgtttatgggctaattgagcaagttgccggttgattttaagggcttgatcacttccgccagtcattgcttcaatataaaaaggacattcaatttctaaattatcagctaattggacatgcaaatcaacatcatccgtcgtcatttcaggtaagctatcatgaattagacgcacttgatcaaaataatggtgttgatgaacctggtcataatatttggcagctaatgaaaggtgttcgttttttcgttgggcatgacgtgattccatcatggagcctcctttgatctacttgtgaatgtaagaaagatggtgcttaacagatttcttgaaactttttgcgttatcgataaagtgtacggataaaggaagttgttcgatatgatttttggcccaactctttaagacattcccaaagttagagttgctatcaatagcgacgatcccacaatcaccgccaccggcaccagatgtcttagcggcgccaccaaaagattcagcgatttggcaaagcttagataatgattcggtttcgatgtttacccctgaattagtgcccagttgttttaagaggtcacggttataacggatttcatttttaattgcttcaagatcttgacgatgaaaaccatcaaccattcgttggatacacgatttacttttttcaagaaaatgatgatattcggtttggcgacgggctttaaaaagagaaattttatcaacaagttgggaagttgatgctggtttaccagtccagccaattaaaagctctaagtttttaggagcggttagagactcaatattaagatcaggccaaggtaagtcaatgattgtctttaggtcaaggtacttacgttgttgggcaagccactgccgatcaaatgaatggtaggaaatccaaccaccgtatacagaagcggcaacatcccccaacgaaccatttccttgaacttcaaaatgggcaattgcagctaatttaaagatttgatctttgttaacgggcaaattatagaaccgacaaagggccttaacagttgctacagtaacagccgcagaggaaccaaggccatattttcgaccattagcactgtctaattgactgtcaatatggatattaaatattcgtaagtcgcgactaaaagtacgagcatattcttctgtaaccctaatagcagaaagaatgtaagaaaaaggattgtcacgcttatcaactaccatttggtctcctaaacgtcgccaagatagttgatcgttattatactggcgactaataatttggccaacttcttgcacgctttcctcaatcgtacaggtaacaaactgatccaatgcaactaaaattgcaggataaccattttcaacaacagcatattcaccggcaatatataatttaccgggagctttttcagtaatcaaaatttaaagtccccttatcattaaattttattcattccaaatctttattccaggtcccggttgtgaaaccaccaaccgttctgggccaacgatattgcttaattcttcaacaattttattccggttccctcggtcgtaaatcactttaacgttcggaccagcatccatcgtataatagcagtttactccctggttgcgcaagtcttccactgctttaatgatggttagcgtttcaccattaaagtaggtaaaaccggggtcagctgaaaaggtaagtgcgtgcatccgaagggcattttcttcagcaatatggccgatttggtcaatatcttttgctttgatagctttctttatagcaaccatatcattcgctaccacttggcgccaagcatcatagtagggtgaagtttcaacactggactgcattccagatcgactcgaaacttttttcttttttgtatcaactaagactgctaacatctcgattggaaaatcaacattttctaaaactggttgtgcaaaggacgagtcatcgtcagttcctttttgccattcaaccagtccaccataaatagacctagttgccgaaccggatccacgacgggcaagtcttgataggtcacggcttgagaggtttaatccggccgctacactggctgctcctgctaaggcagcaaaggcggaagctgaagaagcaaggccagcagcagttggaacatgattaattgagtctacccgtgcgaaagattttatcccacttagttgacgaacaatatctaaaacatgagctactttttgggcctctttcttactaaggatatgttgatcgatggcaactaagtctgaagtaagatggttatcaaaatttacggtagttgtggtgtaaaattcattaagtgtaagggagagactgtcagtttgtggaatgattaaatcttgatccttctttccccaatatttaacaagcgcaatgttagtatgtgcttttgcagttgccattagttattacctcgcttatcaagtggttggagccaaatatcatgcgcaccgttctcttttagaatgcttgcaaggcggcgagcccccatagctgtttgcattaaagcgatcatgcaaccgccacgaccaccgccagttaatttagcaccgagagcaccattgtcacgtgcaacatgaataaggtgatctaatgccgggtctgacacgttaagagcagctaaatcagtttgcgcaaagttaagcgcgtcgcctaattttacaatgtcattttgcgcaagatagccttttgtttggtttactaattcaccgaggtgcttaatatgttcctcagctttttcgttgttgttttttaattcatctttaactgctaaaatagcttccttagtagcacccttttttccggtatcagcaattactaaagaggcatcaaggttcatttcaattggtaccccaatccgccccttaacataaaaaagcggtttatctgaactgacagtagcagcgtctaaaccggatggactacgatgtgtaatttgttcctcaacatctgcaagctgaagcaataatgttcgatcaagcggttcatcataatagtcaaagaatgcccgaataattgcaatcgcgctggcagcagacgaccccattcctcgttctgcaggtaattgactttcaatttttaagtcccaaccagtttcttggtcattaaaccttgcagataaagtgtcaattaattttttaattccaatcatggaagaaggtaaattttctaaactaccatgataataacggcttttaataattcgctggttatcttggcgactgctgagcgtaactgataattgaacgcttggcaatggtaaggctattgccggttgaccgtatactacgctatgttctcccattaaaatgattttcgcatggctagtaccaatcccttgttgtttcaccatcgtaacctactttctacataaaaattcaaacttaatcatagcataaaacagtgattctagctaaaaacgattgtggatgttaccaaatctaaacattttagcacaaagaaaggccgattcgtgtaaaaatgagaaatttatagtagaatggtgtatcatttagtttagaataattagtaacttatataataacttcggagaaatatggtgatagtgtgacacagcgtagtagtcagcgcacaaaaaagcgtgacaagaaagcgccaatctactcagttgttgatttagaaacgaccggaacgaatgttaatcatggtgatcgaatcattcaaatcggttgtgttctcgttcaagatggcgaaatcataaatcactttgaaacaaaaataaatccacgagagaaaattcctcgttcaattgttcaattaacaggaattgaagataaagacgtacgaaaagcacctttatttgaggatattgctggaactatttatagcttgctggcggaaacgacctttgtggctcacaatgttaattttgactttccttttctaaatgcagaattagagcgagctggatatccttcattgtcaattccagcaatcgatactgtgacccttagtcagattcttcttcctactgcaaagagtttccgtttacgagacttaactagttcgttgcacattgagcatgatcaccctcatagtgcagtatcagacgctgaggcaacagcagacttacttaatgacttgctaaaacgagttcaagaattaccaacgcttacgcttgaaaagattactcagttgaagctcaacttacctcaacaaacagctggggtttttgatgctgagttacagcgtcgacgtaaatcgccccagccattaagtgaagagctgtatgtctcgcacggaattgttcttcataaatcgcggccaatcactgctaatagtcagcgggaaaagcataaatatccttcaactaaaaaggcaaaggaaaagctatacggagatacgttgagactgcggcctgttcaagcaaaaatgatgaacagcatttacaataattatactcatgatgaacccaaaaatatgattgttgaggctggaactggagtagggaagacattgggctacctttttccgctaagttatgttgcatatcccgataagaagattgtcgtcagcacagcaaccaatatcctccagcaacaaattattgatacatcaatcgcgcaactaaacaaggtgttgccttttaaaatgaatagtgtgattatcaagggaaacgctcattatattgatattgcacgttttgttcattccttaagcgtaattgaagattcgaagctcgttcagttattaaaagctaaaattttagtatggctgctttcgacgcaaagtggggaccttgatgaacttaatttaaattctcagcagtcgccatactttactgaaattcgtcatcagggtattcggagcttgaatccagtaaatgccttttaccatgatgattttctcgttcggcgggaaaaacggcttcatcaagctgatattattattacgaatcatgcgtatttggttgctcatgcccaggaattaggggatggaactcgtcgcccatacttagtaatcgatgaagctcagcacttaagcgaaagtatcttaaaacggtcccggcgaacatttaattttcaaaaattacgtacggccgttcatgtaatgtctgggttagttaataatggtaatgaccgaaatttaaccgatattttcgctgaacaggcactaggcagttataatgttgaattgcttcgtggcgatctcaatgcagtagaagaagcagttgaccttttccaacaagccctttaccgtcaatacatggcaagtgccactagtaatcccgacaatgaattaattgaacaaccattgcgaaatgatcaggtgatgtctctcttagatattagtggacccgtgatgatgaagctagagcaagcattaagcagtgtgcagcttcatttttctgccctcagtcatctgtttagcagtcagccagaccggtggttgttaagtgatcgttaccttatgagccaatttcagagtcagcttgcaaaattaattgaggccgatcagacattaaatgaatttaacgaaacgcttcaacaacaaggagaggctgctgctttttggattactattcgccaatcaagtgaacaaagtgccttacagcttagtggggggctattggaagcaacccattacctcacaaagaatgtttatccatattttgctcaaccattatttgtgggagcgacattgtttacatcgccacgatcgccgtatctttaccaccaattagatttagagcgcaataatactttaacgcgtcgattcgcatctccatacaattacaaacagaatgctaaattattgattgcagaagatgccccagtaccgagcgcgcaaaataacagtgattacattaaatacctcagtgacacgatttaccaattaacgaagaatgctgattatcagacaatgattttattcaactcattggtgatgattgagcagatatatagccaacttcgtgaaacggatctatttgatcagcgagatattttagcccaaggaattacgggtaatcgtgataaaatcttaaaacagtttagtggtggaaaaaattcgatccttcttggtgcttctagtttttgggaagggatagatttaccagagtccgctcttgaactcttaattattacgcgcttaccgttcgattcgcctgatgaaataatgaatcgtgctcataataagttacttcagcagcaggggaaaaatccgttctatcattcagaattgccaaaagcaacgatgcggttacgtcaggggattggacgattattacggacagaagatgatcatggggtggcagtagttcttgatccacgactacagacaagacggtatgggaagacgattttgagtagtctgcccactgatttaccggttaatagcaaaaaaactgctgacttgatttcaattactcagaagtttttacgaaatggtaaagaggacaaagttaattaaactttatcaacttttaattaccgatttctggtataatcaaaaacgattgtcatataagaatctaaaaaactaaagagataagagggaaaagatatgcaaagtcgacgtgaagttcaacgtgaacaaagtcgcggttcctcaatgcggacaattcgtaaccttttgattgcgattttactaatcttgttaatagtgtggagtgtttttgcagttagcaatcagccacgaaattcagcgcgacgacagacgatttcacttgctgaaaaatatgctcatcttcaatctcctgaccaattttatatttataatcgagagaatacttactatacgattagtggcaagaatcagcaaaaccaaccgatcctggttatggttccccaacacggtggcaagatcagagttctaaaacaatcaagtgggattactgctgcgagagtacgagcgatgacaaaatcaaatcgtgatccgcgagaaattttaaaagttgctcccgggatatttaatgacaagattgtctgggaagtaacatatcgtaatcaaaaagggaatctctgctacgatctgattaattttaagactggacaatatgttcaaaatattaataatctttaataaaagctgaaactaatagaggctgggattactcagtctctttacttttgcaaaaatattttgttaagagaggggctgattaaatgacagatgcaagccttttacagcattacttgcaggcgggagaaacaaatataagcaacttattgctccatcattataaagaactggggatgacaacttctcaatttgtcttatatcttcagtttaaatcttaccaagatcggggaataatgaatccggatgttcgcacaattgcaaagaacttaggaacaaaagagcggcaggtgtttgaacagcttcaccagatgatgacaaaccatcttgttgagcagaagatgcgaaaaatggaagacggcaaagaagatgcaatatatgatttttcgctccttatcaacaaattagcattgctcaatgagaatgaccaagaggcagcggttaaggttgaaaatactaatagtcgggttgagacatttaatcagctagaggccgaatttggccggcccctctcatcaatggaattgcaaattgttaatgactggctggataaagataattattcggcaataatgattaaacttgctttacggcaggcagtaatgaatagtgcgttaaatcttcaatatatggaccgaattctacaaagctgggatcgtcaggacttacgaacagaaagagatatcaatgagcatgaaaagaggtttgaacagcgaaaagaggctggacaaaaaccagaaaagaagacattgaaaaagcctaaaataccgatttataaattaggcgaataaaattaaataaagggtggttgacatggaaaaatcttcttctcaagtaatgaagggaattatatgggcagcggttgcctctgctatgtggggaatatccggaaccgttttgcaacttatctcacaaaatttagcaattcctgctacgtggatgctctcaatgcggactttttcagcaggagtgattttattagtaattagtgtatttttatatggaaaaaagatttttaacgtatttaagacacgagcaacagctatttcagttattagttatgctattttaggattgatggcaaacctgcttacgttctattatgctattcaaacaggaaatgcctcagcagcaacaattcttcagtatctttccccactttttattgtgttaggtggaattgtttttatgcatcgtcgtccgttcaggagtgacattattgcgtttgttgttgctttgattggggtagcattatgtatcacgcgtggtaactttactcaattagctttaccatttgtatcccttctctgggggttgggatctggaattacagctgcgttctatgttgttcttccacaacgagctgctgatgagaatccgccaattgttgtcctcggctgggggacgatgattgccggagtcttatttaacctctaccggccattctgggtcaatccaccacatattactaccacattagtagcatcagttgcgacagtggtattattcggaacgattttaccatttggaattttgcttcatgcaactaggtatgccccttctgatgtagttagtatcatggatgccgttcaaccaattacaacttcgattttaagtgtaatcttctttaaattgaacttgaattgggcagaaattttaggaattattttagtaattattgccgtctatattctacaaaatggtcggcgaaaacatacaattcattattaaaaagttgataataaaaaggattgcggagaaaaattccacaatcctttttattatcttcaatttttaaaagatcttatcatgggttggctgtgctaggttgcgtagcaggggcaaggctagaacttgagctttgtgcgggtgcagatgaacttgaactagccggagcactacttgatgaagattcagttggggcattgtttcgttcttctgtacgactttcgctgctactatttgaaacagaactggaagaagatgaagacgatgatgattcgcttgagctagaagtggaactgctatcacgatcatccgatgtatcttcagtataatcgaatgcccattttgaatcacgaattacaagctgacgtttacctttaactcgaacagcttcaacagtgtctggcatcgtccaatcagatgcgtgattttggctgtcaaggtattgcattaagtccttgtaaagtaattgcgctgactttacatattgttctgaaatactgccaccaggttcgagtgggtggtcataaccagtccaaactgcaattgagtaattcttagtataaccggccatccaggaatccattacgccagactggctagaatttcccgggtagtttgtcgtccctgtcttaccagcttggttaacaccgtcaagtcgagcgtcagttgcgcttccttgtgagtctgtgaaaactcctttaagcatatcagtgatcatgtaggcagtagccttattcattgcgcgtttacctttaggattgaattgttttgctgcaccatcttgagtagtaatcgagctaatgtagtaaggcttgtagtaagtaccaccattagcaaaggccgcatatgcagcagaaacttgaagtggagagatatacaaagcaatcccgttttgtaaagtatatggttgtttttgcgaaattcctaatccatcaaggaaagaagtagcacgcttaatcccaacggcttgcaatgcgcgaatagcaggaacattccgtgattgaactaaagcctcacgcattgtcatattgcccttgtactttttatcaaaatcatgaaggacagtattggtaccaggaaagacaaaccgcgtatcagcaattgatttgaaagttggccattgcaagtattcgatagccggaccataatccattaatggctttgcggttgacccagaactacggttactttgcacagcccggttaaggccatacacaacatttcctgtgtgacggccaccaagcatggcaatgatttgcccgttatggggatcggtaacagcaactccggcttgcatcttgtcattttggaactgaacgtttttgtttgcagcgtcgtaaagatgttgttgcgcatcaaggtcaagattggtatgaacctttaacccatcactataaggattgtatccttgtgcttgtaaatcagcaagaacctgttttacataagggtcaacaaccttagaatcgacagcagttccacttcctgaaatattaccgtgatcaggatctaaaccagcagtaacgctttcacttgctgcttggttagcctgggattgggtaatgtaattgctgcgaaccatcgcattcaatacttcatttcgccgttgcgttgcatactttgtgttgcttacaagtggattatagtaagtaggagattgtggcattccggcgagaagggctaattgggaaagatcaagatcgtttaaatctttaccgtagtagtactgagctgcggtttgcattccataaattccattgcccatgtaaaccttgttgatgtaaaaatcaagaatctgactcttgctaaaatgctgctcaacattaatagcaagccaagcttcttgggcttttcgttttaatgttcgatcagaggccgctgttgagaaaacggataatttaactaactgttgagtcagcgtacttcccccctgcatcccggctgaacgaccaaaaacattagaagtggctgctccaagaattcgaattgtatcaacaccatggtgcttgtagaagcggcgatcctcaattgaaacaacagcattttttaactgctttggaatttgattatccttggcatattctcgtttctgtgctcctaaacgagaaattactcgattttgatcatcgtaaatagtcgtaatactctgacttgttaagtcgcttctactaatcttaggagcgcttgaggcatagtagaaaaataaagctgcagatgccaccattaatagaacgacgattcctgctacccatagcaagattttctttattaagccgccaacattgcgctgttgattgtcattgttattatgacgctcactacgcgttgactgattatcatttgacatagtaaactcctttacgcttttgcagcaattattttatcaactgcgtttaaatatggtaaacgcggattgagttgataatgaatttgatagccttctttagcgatatcagttcgcaaaattgatttacggccgccgttttgctgttggtcccaatatttaaataggttggaagcgggaagcaggtatagcaggtcaagctccgtaaatttaatgaaagcaaaacaaattcccccctgtgctacacattcacgcatatgctgaatttggtggggatgaaagttctttaatggaaaagaatttttattacgtgtttctttagcatcaaaatcaatgtaatatccacggtacaccccattgtaatcagtagttgatggacgtcgaaaatatgcttctttaataacagccgcactccgcttggggtaatcaacttttacaagctgaataggggtaggctttttatgaataacagcaatgtggcgagctaaatagtactgattactatgattgatctcatcctctaacgacatcccacgtttagcataaatagattgatgtggtgtcggtaattcattatgtgtattatagtgttgtacaggttgctgaccattgggatagtgaatggtcacggcgatcactctcctaactagagatttattataccagactagttgcataatgattgatacaagatgattacaagtttaagttaagaggctttatacctgtttatttagggaggattttatgaagagagtgtgggttactggttatcgaagttacgaactaaatatatttaaggataatgatcccaaagttcaagtaataaaagaggttcttaaaaattatttaagggcccaattggaattaaatgatgatgaattctgggtaataactggcccacaaatgggaacggaaagatggggactcgaagctgccttagaactccaagctgattttccgcaattaaaaacggctttaatgtttccctttgcagaatttggtaagcaatggaatgaaaataaccagttaaagctgacgagtattactcagcaagttgatttttttgctaatgtttcagataaaccttatcaatccccgcaacaattgagaaattatcagcagtttatgcttacacatactgatgaagcttttcttctttacgacccagagtatcaaggaaaaactaagtatgattatgagataattcaaaaatataaagaagaaagtgaatattcaatgacttttgttgattttgatgaacttcaagaagaggcagaagaatgggctgagcgtcaaagggaaaaagatgaattttaaccttgcattttttctttgatttggtattatagttattggactacgcaaactaaacaattgaggtgtttaagttggataacataaaatttactccacaagatattttgcataagcaatttaaggagagaaatattggcaaaggctacgatgaagcggatgttgatgctttcttagatgatgttattaaagactacgacacctataataaagaacttgaacgtttaaatgatgaaaatgaacgtttgagagcaaaggttgatgaattaaatcgccaagtagaagttggttcatctatgagtaaccaaactgcttcccgtcaacctgtatcgagcgctacgaatatggatattttaaagcgtctatctaatctagaacgtcgcgtatttggttcacaattagatggtaacgataataatgactcacatttgctttagtgcgtgtcgaatagtttattaataattttgcaagttttgggtaattgagcacagcttatgttgtgttaggaaggtccatgctcgcacaggctgcgatgcctgtagtgtttgtgctcgctgaaaaaataaggcggggcaccattttatggtgacggcggaaaaacggactaaggttttaactatgtcttagtattcctgaaaagtgccacagtgacgatacaatattggaaacgatattggtggaacgcggtaaacccctcaagcggtaaacccaaactacggtaggggagctttggatagcaaattgaagtgattccaggggagagtatttcgatactctgagatagatgattacctcgatataattatgcctgataattatattacgacaaaacatggcctacagatacttgcatacaggcacccgagttcgctcgggtttttttattttaaaaatcagagtatggttttattggttcttttttgtagaatgcgttaataattactcgcttgaagtaaaaaagttaaatggtgataaattaaattttagaagtttaagatagatatcacttaaaatagcaataaaatataaataatcatttcattttactgcaagcgcgcctataatgttaatggagtaaaaaatgagttatttgtgagttaacttatctctcgattaataaaaatatcagataataaagttagggaattatggataataagagaataaaaattgtatatatgtcgttttctgggaatgtacgatcatttacccatcggcttcaagaatacgcaacacaacagcatcatttaaataatgaaaatcctttaatcgatttattggagatttcagaggagacacttccgaccgaaagcgatagtaaattttttgttttactaccaacatatatgatcggtggaagtagattcacaccgacgttaacagaaatcttaacaacaccaatgcacgattatttggaaagttatgataatgttaaacgttgtgcaggaataattggcagcgggaacttaaccttagggaagatgtatgtaataactgccaagacatacgctaaggaatacggtttgcctttattggatgcatttgaatctcgtggcaccacccgggatattgaacgcatttacaaaatattaactgataaagcaaatgaggattcattaatgtagttaggttaaagtcaactaccattcataaacaaaagagattgcaaatttttcgttttgcaatctcttttgtttcttcttgcagcttcttttcattttgaagcaacataaggtaaaataactaataggaataagtctaaaggagagtttaatgtgcaaacatatcagttaattgctactgctgctgcaggtattgaagcattagtaggaaaagaactaagagaccttggctatgaagtcaaagtagaaaatggtcgggtgcgttttcaagggacaatgaaggatgttattcggactaatctctggctacggacagcagaccgagtaaagattgttgtgggtgaattcgatgctcggtcttttgaagaattgtttgatcgtactgaaaacatcgcatgggaagattttttgccaattgatgcgaatttcccagtagaaggaaaaagtcataactcacaattgcataatgtgccaagtgttcaagcaatcactaaaaaggcgattgttcaacgtctcagtaatgcataccatcggcggactcgtttagccgaaactggtgccacttacccgttagaagtagcgattaataaagaccatgttcttcttacgttagatactagtggagaggggctttttaagcgtggatatcgtaaaaataaaggtggagcaccgttgaaggaaaatatggcagccgccttggtgatgctggctcactggtttccagataatccatttgtcgatcctgtatgcggttcgggaacgattccaatcgaagccgcattatacggtcataatattgcgccgggcatcaaccgttcatttattagtgaacaatgggttaacttagttccagatggtttatctgatgaagttcgggatgaagccgattccttagcaaattatgatatcgaattagatatccacggatatgatattgaccaaaacatgattgatatttctcaagaaaattctcgtgcggcaggtttaactcatgatattacgtttaagcaattagccgtaaaagactggcaaacaagcgaagttaatggagttatcgttgctaacccgccatatggtgaacggctaagtgataagaaatcagttcacgaactttaccggcagatgggtgagttatatcgtccattaaccacatggagtaaatatattttgacggctgatatggaatttgaaaagtattatggagcacccgctaccaagcgtcgtaaactttataacggtgctttacgaacagatctctaccaatattggggtaaaaaagatcgctccaagcccttaaatagcaagggtttcaacgaaaatgctgttttaaaaacgtcaaaagggggataaaagggggataaaagggggaaattctcccaataataaaagccttagtaggagttacattgtaacgaccgctaaggctttttctctgtttggtggctgatagaacacgtggatgatataattaagacgatatgctgttttctaaaatcactctattttgtggagggcctgatttgctaaattatgtgctccacgattttgactttcaggaatccactgggtaacaaccgttggaaagtgttggaggagaggatttagtgctgctaattctttttggtaatgttttgtataatttttgccgattgcgtcacttaagatacgactatcagtataaaataggattgtttcattattgctaaagtgatcaattaaatatttaaatccaaagtgagctgcagcaaattcgccatggtgattatccattttttccttatctactggaattgcaagctgaatttgcttatgattggcaattattattattcccaaaccagtagggcccaggtttccttttgttgcagcatctgtaaagattttgatcataaaaactacctcttttctgaaaggatgacatttataattatggaagaagaaactcgttatttttaccaaccagaccttacggggacaattattagctggtgttggacttttctcttctttattgccggtctcgtaatttggcttgaaattactcattttcagtggctcagcgcgctcttttttgcagtttttgtaatccttgccttattagaatggcggcgacgaaccgtagtaatcactccgactaaaatggtgtttaatcgcttgttacaaaaacagtacctcgttatccccatctctgatattcgtcagccagagtttaccaagcatacggtgacaattactgtgaatggagaggtaatgagttttacctttaccaccaaagcaattgcacgtttgaaattggcattgaaacaacagggggttcaataattgttactagggatcgctattgtaattattttaattttaacaatttgtgaccaattattaaaatcttgggttgcttcttcaattgttcttggtggtagtaagcagttgattcctggtattattgagttaactaatttacgaaattcaggggctgcttggagcatttttgaagggcaacaaactttttttaccattataactattgttgcgattattgtaattggttactttatctggcagtaccgtaaaaatattcctatgctaattggcttatcattgattatggcaggaacaattggcaactttatcgatcggttaagacaagggtatgttgtggacatgtttgaaacaacatttattaattttccaatttttaacattgcggatatgtgcttaacaattggcgtaatctggctaataatttgcatcttaaaggagaaagactaacaaatgtctgaagaattagaattaacaattgatggtgagatggtgggaaggattgataagcagcttggtcatcactttgatcaattttcccgatcacaaattcaacattggatagaagatggtcacgtccttgttaatggcaagcaggtaaagcctaaatataagttgcttgtaggtgaccacgtccaaataattccagaagaaccacaaaaaattgatttagcacctgaggatattcctcttgatattgtatatgaagatgatgatgttattgtcgttaataaaccgcaggggatggtcgtgcatccagcaccaggtcatccagatcatacgcttgtgaatgctcttttatatcattcaccactatcaactattaacggagaatttcggccaggaattgttcatcggattgataaggatacctcaggactattgatggtagccaaaaatgatatggcgcaccgttctttgacagctcaattaaaggcaaaaactaataaacgagaatatgttgcgcttgtgcatggagttataaaagaagataaaggaacaattgatgctccattgggtcgctcattaaaagaccgtaagaaacaggcagttgtagttgatggacgtcatgcggtaacccattttaatgtgttagaacggtttaagaattataccttagttgcttgtcagctagaaacgggacgaacccatcagattcgcgttcatatgaaatatattggtcatccactggcaggagatccgttgtatgggcctcgaaaaacactcgctggcaatggccaatatttacatgctcgtttgttgggctttaaacacccccgaacaggtaaagaaatggtttttacggctccattaccagcttattttgtaaaaatgcttgaacatttacgcaagaccgaccaataaaattattgtgtttaatttggagaacgttcataataatattgatcaattattaacaaagttttaggagagtgggacagtgacagcacgatacctaatatttgaagatggctcaattttcgctggcgaaggttttggttcaccagctgttacttttggtgaggttgtttttaataccagtatgactggttatcaagaaatcatcactaatcaggtttacaataaccaaattgtcgtttttacccagccaaatattgggagttacggcattcaacgtaatatttatgaatccattgtaccgacaattaaaggaattattgttcgttcccttgctgatgctggaactaatgataacggacgccaattgactcttgataaataccttcaacaaatgaacattccgggaatcactaatattgatacacgggcagtagttcataaattaagaaaagctggaaaaccattaaaaggaagcattgttccagttccggatgatcacgcttttgaccagcttcatgcgactgttttaacgaaccagcaagttgctcaagtctctacttctaaaccatatcctaatcccggaattgggctaagcgttgttgtgattgactttggattaaagaatggaatattgcgggaattgagtcgacgaaaatgtaatattactgtcttaccatatactgcaacggctgaagaaatattacgattagatcctgatggggttgtactttcaagcggtccagggaatcccaataatgttcgtaagtcagtcctggaaatgattcgtactgtccaaactaaagtaccaatgtttgctattggattgggccatgaattatttggaatcgccaatggggcggatgtccagcaaattccagttgaacaccatggcatgaaccatccaattcatgaaatcattactgaccacattgtttatgcaacccaggcagaaggctatctgattaatcgtaattcagttgaccgctcccagctttttattacgtatgttgatatgcttgataatagtgttcaagggcttcgtcatcgtcgttatccggcgttttcagttcaattcttccctgatggtgcaccgggccctgatgaaactgatggcttatttgatgaattcgtcgatacaatgaataggaggggggatcgtcattgatggaaaagttgaaatctgtattaattattggagcgggagccaacgatgttcagcatggagatgagctcgactctgctatttaccaggtctcacgcgtttttaaacaaatgaagataaagactatcttggcagacgataacccattttcggtaagcttagaaaacgttgatcacggttgcattgtcccattaaaagtcgagagcctagtagatattattaataagtttcatccagatgcaatcttgcctactttaggtaatcgtcgagcttttgagcttacccaagaattgctagaaaaaggaattattcgtaaagaaaatattcaactgctaggggttcctgaagcaactattcgtcaaattaatagtgctgttttgcttgaacgaacgcttcgacaaatggaagcaccagttaagaaaatcgtaacggttaataattatcaggatgctttggatgaggcaactaaactagggtatccagttattatcaggtcagtattacctaagagtagcagtacgcgtaaaattgtgcatgatcgaagtgaattggcagatgcagtaaaggtttgcttgagccagtcgcgggcagaacaagtagtagttcagcaaagtcttgccggctataaggaaattgaagtcgtcgttcaacgtgatagttctggaacaatgatgatgttgtcaatgattgaggatatggacccaatcggtatccatgctggtgattcaattgccttcaatcctgtccagacacttcgcgatcgacagattcaggatattcgagatacggcttttgctattacccgcaaattaagaattgtcggcacgaaccatattcagtttgcccttgatacaaacagtgatcgtttttatgtcattaagagcagtccatactttgatcgaattacagcgtttgtatcgcagtcgactggttatccaattgcccaagtaacagcacaattatatgcaggaaagcatctgcgggacattgatcttggtgaaaattatgttcatcatgcggctcttatcgaaccaacaatggatcatattgctgcacgggttccaatatggggattcaacgatttaccaaaagctagtcgtttacttggaacagaaaagcggtcggtggggacggtttttggtatcggccgaagtactattgaagcactttttaaagctattgaatcccgttatcacgagccagctgactttcatcttgccgctcaaaagcaattgactgatgaccaattaatcgccaaaattgtccaccccgaagcaggccgactttttgtattaattgaagcaatgcagagagggtactcagttaatgaattagcagagatgacaaagattgatccgttttattttgaacagattaataaaatgcggttgttgattcgtgaaattgctgatcatccaaataaagagccggttttgcaaaaagctaagagttacggcttgagtaaccagcttattgcaagactgtggaatactacccctgaacaagtttatcagatgagtatagaccaccaattattgacaaagtataaagaaatcgaaccatcagctggggagtttgatcagcatactaatagtttttactctgcttacgaagaagaaaatgaaattagtcgaacttctcaaccaagcgctctggtgattgggacagggggcttacgattaggattaagtaattccggtgattactttgttgctatgatgttaaaagaacttcataatgaaggctttaataatgttgtggtaaattcaaaccctagttccgtcacttttgatccagagttagctgaaaaacgttatgttgaaccggcaacaattgaaaatatcttgcaaatattacggatagagcaaccccagtatttgtttattcccactagttatgataagttactaaaatcgttgcagaattatgatctggatgtaaaaattgttataattccagatgaattgccaactactgctgctagtagcgataggcaacgttactccttcaattatgtctatgatggcaattatgcttatccattaggaacaatgactgatcttttttcaccaattgcgttaaactatcaatccaccgctttacgctacccggctgatcttccttcatcaacttaccaaaatcttaatgaccaggctagtattgctgtattaaagatggaacagccagggttataccaagtgatttttgaagagaatgatggtgaatttaatttaatgaaagttcaaccattatcattaccagaagtatcctttttatcaaaagcacttcatattagcttaccaggaatttttactcaattattcactggtaaattcgataaaatgctggagcccaaaccggtatcagggattgttaattatcgtgcaactttcccatttaaggcattgcgagttaagggtggaatccctgcccgtaatcgagtcattggtgcgcagatgcaatttttaggagaataatttagagatataaagggagcgagacagaagtcacttgtgacttcgttttcgagcccccgcaagcaacaataggcctctaacgttcggttttgccggacgttagaggccattgttgtactgcgtatttgctttttatgaaagtaacttaacttatgtcacagtccctttttagttagaaagtttatgcggtgttacataaagtgttttctgacctgtaaaaataacaaagccaggtttagctccgtttggcttatgaagtcgcttgacaggaagataatcaacgggcacattatctgaatcgcgacctttagagaagtatgctgctaactgtgcggcttctagaatcgtatcttcagatgggtttgttgagcggattaccacgtgggaacctgggatatctttaacatgtaaccaaatttcatttttattagcaattttaaagctaagacggtcattttgcaggttgtttttacctactaaaaccgtagtgccatcactagtatggaattcttctggagcacttaccttaacttttcgttgctttttcccgcttttcttctttttaatataaccctgttcttgcagttccagtttgatctcttgaatatcagcgggagcagctaatttaatctggttttcaatgttttcaaagtatttgatttcatcatttgtcagttttagctgttcctttacatactcaacagaggttttgagcttattatacttagtaaagtacttttgggcgttgcgcgatggtgataattctggagcaagcttgatttttagtggcttattatcatcataaaagttaggaagttcgatttctttcattcctggagttaatttactaagataggtagtaaggatctcaccacaaattcggtactgatctgcagttgctgcatcttgtaattgttgttgcagtttttttacttttcgccgatctttttttagctcattcttcaatacctttaacacttgcccagctaattctttggaacgatcttgctctgctttattagcatagaaggcatcgagaagggcagagagggagtcgaaatgttgcaactcaccatcaatatttaatggagggaacacagcaaattgagtttttccattagagtgggtgattaatactggctctggattttcaaagtgcttaagaaagtgctgataggtagctggtaaattatcactttgcagtaattctgcagctaattcccgtgcggagtctttgccaaatccttgataatgctcctgtaactgatgacttaattctactgtgtcatcggtttgtcttacaagatcagagtagacctggtttggcaagtaagggttaactttatcttgctttggtggcatgacaaaggtagcaccaggtaataacaggcgaacccgattttgatctgagccaacatgcttaatggtgtcaatgattttacccgtcttgagattaacgagtgaaatattactatgccgggccataatctcactcacaagaactaattgttgactatctcctaattcatcacgagtgtcaaaggtaattttgataattcgatcattatcaacttgttcaattttattgacgattgcaccttcaaggtatttccgcattgtcattgtaaaattagttggaaccgccggatttttgtatgggatctcagtaatttggattcgtgggtatgttggattagcagaaatgagtaatgggtagttgtgccggtgagcacggatcgtaatgattaattctgcagggtaaggttgactaactttggctacccgaccagtagttaatttttgatctagctcatggacaattgcatgagtaaacaagccgtcaaaagacattagtgtagcctcctaaatattataattacaaacgaaaatagcactattaattatacagttttacatcattaatgaaaagtaatgttactttagtggacatatttttagttggtttagggccgtcaatgtggtatgctttttgtattatgtgggtgaaatccgcgtaaaaacgcaattatttttaattatacaaatttagaacatggagttgataagatgaaaattgctgttgttactgacagcactgcctacctttctcctgaagaggcggcggctaataatattcatgttgtcccaatcccagtgacattggatggtcaaacataccgtgaaggtgttgatatttccaccagtgatttttatgaaaagatggcaaattcaagctcttttccaacgacttcccaaacgccaatcggccaattgatggaagtctaccaaggattagctgatgatgggtatgatgctgtgattagcattcatttaacacgggctattacaggatatttggatactgttgaacaacttgctgaacagatgaaagatacaatcaagatcgtgccaatcgattcccacttaacagttaaaatgatgggatacttagccttagaagcagctaaattagctagtgaaggcgatgatttagatgacattgttaaaaaggtaaaagaatatcgtgacacctttaataatgtatttgtggtagatgacttgcaaaaccttgttcgtggtggtcgtttatcaaacgcctctgcatttgtaggctcaattttaaaaatcaaacccctcttgactatgcatactccaacgtatgccattgaagcgtttgaaaaggtgcggtcaatgaaaaaggctaaacttcgctgtgagcaaatctttgacgaggatattgccaaacttgactatccagttaaagcaatggttattcatgccaatgttccagaggaaggtcaaaagtggcttgataaacttcaagcggatcatcctgatatttcatttgagttaagttactttggtccagtaattggctcccacttaggacaaggggccttggccttagcatggatgcaagacacagcaaagaagccgttagcatgaaaaaacaaactttaattaaaacccttttggcaattgctgcgggtattttgatgatattaatatcatttactggctttcaaaccattttaccgaccggcgaggcgtttatgcctttagctggcgtgattgcagtggggatagcagttgcattaggaattaatattgcatttatcgtgacgctggttagtgccataatcatgattgtcttaggaactgccgactgggtaatattagtcgattttattgttattttgattgtggttggcttgattttacgcaaacaggttccattatctattgatctcaatcattcacaattattatggcttgctatttttaccggcttagttcaattattctttatctcaatcttttatggtctaattggattagtcctaacggggacgccaacaggtggattaacatttgttcaactaattattcctaacgcattactgacaggattattgtatggcttcctagtagcaccgatctcattgatttgtcggtgggtagcgcgaaaagcattgcatattgataataatcatcataatgattcaggtaactctgcaggcgataagcagggcggttcgattattgtcgacttaagaagtgctaaaaataaaaaagatgataagtaagcaaaatgccatggaaaaaacattcgtgtttcttccatggcatttactatttccataaacaatttacatctttgcgtcccattcggcatgaaactcgtcaagaaaatcgagcattacttgttgacggtgatttgcaattttcttggcagtttcagtgttcatcatgtcttttaggtgtaagagcttttcatcaaagtgattaatgatagtttcatttgctaaattacgatattcttcccgggacatattatgacgaggcttaatagctggatcgtatattttttcatgatgaccacctccataatagattgctcgggtaataccaattgtgccgattgcatctaaccagtcggcatcacgtactatttgtccaatgatggagagtttgacttcctctttatctaatgtatgagcaaaagaaatattattgatgacatccataattattttgacttgttcatcactaaagtcattttgctttaagtaatcaactaattcttgtttagctgcctcaacgttatcaactaatttctcatcaattgtatcgtgaaggtaggccgccacaatcggcaaaaatgggtcaactttttcgcccatagctaaccgtttactcatttttactacgcggttaatatggtccatcccatgaccagtcttgtcctgacctaatttttgaatggtgtactctttaatggcagttaattgttctgcttgtttcatcataaaacctctattcttgattggttctctaattattaaatactgaatcgcaattcacgtcaacgttttgtaaaataagatgtgaggagtggaatgaaatgaacttattattttcaattaacgacaagtttgttacgcaattagcaaccgttttattatcaattaaactaaatacgcaagcacaagaatttaacgtatatgtcttacaaaaggacaaattgaaacgaactgatgacttggaaagagtttgtaagcaattaggaatgaactattttccgatcaaagttaatgatcaattatttaacaaagcaccagttacagaccgctacccgacaacaatttattatcgtttactagcacaccgtcttttacctcaagatttgcataagattttgtatttagatgctgatgtattgtgtattaatgatctttcaagtctgtatgagacttcattagatggatacctatatgcttctgccatccatacaaacctgacgaatacgacagaggttattaataagattcgtctgcaaaactttgatgctgacgggtactataattctggtgttctcttgatgaaccttgatactatccgtaaaaaagtaaaggatacggacatttttaactacatccgtacccatacacttctcctacctgatcaagacgtcttgaatgccttatatggacgctatattaagtctgtccctgatcagttatataattttgatactcgtaaaggcggtatttacgaaacgatttcctttggtgaatggacaaccgattgggtaatgcgtaatactgtgattctccattattgcgggcgtgacaagccatggctaccaactaaaaatagtggccgttacactgctttatacaaaaactactttcaaatgactaataaacttattagtgcagcactattactttccccagaagaagttaattaagattttattgacttggggattgtgatgaagtaattcatgtttagcatttggtccggtaatcttaacttcgcggtatgaacgtgcgcggttattaataaggtacttgagcgaaagacaggaagcgtttgaaacttggctatcattgccatcttttaagtcaccataaatattcaataatttaatttgtcgtgggtaacggtgacgtaacgggagtagcttttgataggaatcattcattgcggaaggttttcccgtctttttattcactgttagattagcaggctcattccagccgattgcaccatcaaaagttccagccatcgcaacttgtttttgaatttgcggaaggttatggttaccggcattagcaaggagaaaatacataactgccatgtttcccatggagtgcgcttcaatatttacctttttaaaatgatatttagcttgcagttcttcaagaacgttcttaacccattgaccttgtaattcataatttgtgctatggttgtcattgaaattgaccatcacgagcggattgacagcgttatgagggatatctcctttaagagtaacggttccatcgccagcaacatctgcggtgataactgtttttgacacgcctgctttcacaaatccgtttaccatatattcttctgcatgagcaccgcttccgtaaccatggaaaaagagagtgggggtagtagagtgaatatatttattggaaaggtctgcgtgaattggctttgctgctagtccataaataattgttagaaaaagtgcagtaaatattgttaaagtaaatttaataaatttggtcatataaaaaccttctttttctttttagtgctatcatagcatattgaaggggtaacttttaatagttaacagttgtatttaaaacgtaaagtatgttacagtattagggttgtttaacgaataacacatctaattaatgtaatgagaagggaaggtaatacgatgcaaatcaaacaagccaaaatggatgatttaaatcaaattatggaaattctgcgagatggtcgaaaccaattagccgaacaagggatcgatcaatggcaaggagattacccgaacgaagaacatatcaaagaagatattgaaaaaggatttgcataccttgtacaatcacaagatgatgaaactgttggtgcattatcaattgttgaagcaccagatcactcatatgatgaacttaacggtgattggttaattgacactgatcgttatgttgttattcaccgtgtggcaattcactctaatcatgctggaaaaggatatgcctcagcattattcactagtgtaattgattacattaagaataatcggaaggatattaagactattcggatcgatactcatgaagacaacaagatcatgcaacatttgatcgacaaaaatggctttactaaagttggtgaacttcacggggtttaccgtccagaagaaaattcatatgtttacgccttattaacaggtaattaaacaatcgagtaggagataattgattagttcaattatcgacctctcacaccaccgtacgtacggttccgtatacggcggttcgacaacttaatcactttgaattgactggagcgtcttggacatattcataagtccgagttgttccagttttctatttgttagagaatagctcaaggtcttactgtgtgcagttcgccagtagcccttgcgggtactagcgaagacgtatgcatcacgctgggacagccccagcttctgtaagttagttaccttagttttaagcttcttccattgcttccagatatactgtcttattcgggccctcaaccacttgtcaaggcgttgaataaagtcagttagtttcccaattgagtagtactgaagccatccacgcatttttcgctgaatttcttcaaacattcttgtcagagatattccacgattacgtttagttaataacctcaatgctttctttactcgttgttgcgattgttttgctggacgggcgtaggctccattgtggtctacacccaacgaaaagccaagaaactttaaccgtagcgggctaccgactttggttttatctgggttcactttaactttcaatcgcttttcaagaaactgggtaatgcttcgcattactcgttctccggctcgttgacttttaacataaatgttacaatcatccgcatagcgcacaaagtggtgaccacgtctagtcaactctttatccaactcatttagatagatattcgccagtattggtgacaatggccctccttgtggggttcctttttcactcttagcgaaaagcccatggtctaagactccgctagttagaaacttacgaatgagccttagtgtccatgggtcatcaatatattgttgaagatacttaatcatcaagtcatgattaacattatcaaaataggcttttaggtctaagtcgacaactcttcgataaccttgattataaagatctactacttttgcaatagcgtcgtgagccccacggtgagggcggaagccaaaactattatcagagaaaacacgctcaaagataggtgtaagaatttgggccacagcttgttgaaccattcggtccaccactgttggtattccgagttttcttactccaccattaggcttcggaatttctacccgtttgactggtgctggtttatacttgccctcacgcaaactagcgatcaattccgtcttattttctctgagatatggcagaaggtcattgactgtcatatcgtcaatgcctgctgcccctttatttctcttaactcgcaaataagcctgattaaggttattgcggtccaagactaagtcttggatagtgacactcatacctttaccttcaccataatcggtactacgcgcccttgtgtactttcggttttccaaacctatcctcgacaagcggtcagcttgttgttctgttttctgcgattgtcgcacctgattacacctccgatataagttacaagttattgtcgttcagtccttcatctgattactcagactactatgacctcggctgacttctggcttactcaacgctacatcactgcaccgcttgtttctgtggaaattaaacttattcctcttgtcggaaacgtgtaggccagatctccccgggtaaggatattaactttcgtaccatgtcaccggtagctttactgaaagtaacttcgagtagtgttggactttaacttgtcatgcagtcttatccagttagttccagccttatagctacttcttgttcatcggtgcagtactttgccttagacttccttcagattccacctcacagtggacacccttgtcctcagctcatggttccgactactacggcccatagcggactctcaccgcctagctaatacccatgccgggcgcacctaaaatagcgggagactagggattcctaatctctcgctattcttttaaaattaatttttgaaactatgaattggggcgggaataagtccaccacggttaatcatcgcggtacttgcgactttattgactgccattacaggggcatatcctaatagcccaccgaattcaaccgtatcaccaacttttttgccgggtgcgggaatcacgcggacagcagtggttttattattaatcatcccaatcgccgcttcatcagcaatcattgcgctaatggtttcttttggcgtgtcacctggaattgcaatcatatcaagaccaacggaacaaactgcagtcattgcttctaatttagagatatttagcgttccagcgttaactgccttaatcatgccagcatcttcagagacggggatgaatgcgcctgataaaccaccaacatgactgcaggccataatgccaccttttttcacggcatcgtttaacatggctagagcagcggtggttccatgagttccaacctgagctacgccaatttcctctaaaacttcggcaacggaatcaccagcggcagcagttggtgcgagagaaaggtccacgatcccaaattgaacacccagtctttccgctccaacagttcctactaattgacccattcgtgtaaccttaaaggcagttttcttgatcgtttcagcaacgacgtccattgattcacctttaactttttctagagcggttttgataactccaggccctgaaacaccaacatttattactacatctggttcaccaacaccatgaaatcctcccgccataaaggggttatcttcaacagcattacaaaagataactagtttagcatttgtcatcatatcaagctttgaaccagcgacgactacttcacccatttgtgcaacggcatccatattgatcccgctacgagtagagccaacatttactgatgcacaaacaaaatcagtttctgccaatgcttcagggagggaagcgattaacgtgcggtcaccagtttggtatcccttttgaacaagggcactgtacccaccgataaaatcaatccctaatgttttggcagctttgtctaaggttttagcatatttaacatagtcgtggtcttgagaagcagcggcaatgagggaaataggagtaacagttactcgcttgttagcaatcggaattccatattcggcttcaatttgttggccgactttaacaaggttctttgcttttgtcgtaattttgtcatagatcttttgacatgcaaccgtactatcactatcgatacaatcaagtaaagaaattcccatcgtgattgtccgcacgtcgaggttttcattagaaatcatgtggctggtttcataaatttgttgtgaattcattaagggatattcctcctgtacatattaaagattatgcatggcatcgtaaattttggcatttctaaggttaatttcaacgccaatctctttaccgagttctgtaaattcattagttaattgataactatcaagattttcaggaatcattacagacatcatcattacgaaattgccatccataattgtttgggaaacatctagaatattaatttgtttttgggcaaggagggcacttaccttagcgataattccaacttggtcttcacctagaacagatacaacagctttcattaaagaatcctctcttttttttaatgattttaattgtagtataataatatgaacatttctagacaattttagctaataaaggagttgtgacataagttaggtcacttccataaaatacgaacagcgcagtacaacaatggccttcagcgtccggcaaagtcgaacactgaaggcctattgttgcttgcgggggctcgaaaacgaagtcacgagtgacttctgtctcgctccctatagtaaaagatatgaaattggttggatcaaaatgcgcccggcttaccaatatagtcatctacaccgtccggatttcctgaccacttgaacttatcataccagatagaatgcttttcttgatctaacttgtcgatttgcttcatttcatctggtgatagggtaaagtcaaaaatttctgcgttctccttcatacgttgaggatgagtagtcttggtaagaactataaagccttgctgaatttcccagcgaagaataacttgggcaggactcttttgatgctcgtcagcgatttgcttaataacgtcattggaaagaagtcgaccattacctagtggcgaccaggcttcaagctgaatatcattttctcgacaaaattttacaatcttaggctggtgaatcaggggattgaattcaatttgattaattgctggtttaatttttgcgtgatcgagcaaatcagtcattcgttcaacattaaaattgcagacgccgattgcttttgcttgaccgtccttgtaaatatcttctaacgcgcgccagctttcattgtatttatcattaactggccaatgaagaaggagaaggtcgacataatttgtttgtaacttttttaattgctcattcactgcttgccgaagtttatcataatctccttgatcaccattgaaaattttagtggtaagaaagatgctatcacgtttacggccagtagccttgaaaccatcttgaatgccttgtccgacggctgcttcgttaccatactgtttagcagtatcgatcaaaacataatcattcataatagcctctttaaccatttgctgtgtttccgcaagtgaggctttccagactcctaagccaagttgggggatgaggtgaccgttgtttaattttatctttggttgtagattttgattcattggttgattcattttaattaaattctcctttctaaatcagttataacattaaatactttaggatccttgaatttgctcgttaacaaactgaagaaacttttcgattgctggagataagatggtatttttgcgccaggcaaggacatcccctgtcgatttgttaggcacaaggggaacaaaaacaaggtcaggatcatgaaaattattatagacgcccttaattgtcaaaccatagtaattactatttcttaaaagggaaacagtatttccaggtaaactggttgtcgcacggatatttaaacgcgtttgatctaattttaaaatgtcactaacttcatcgcgaacaatactacggtggggaagaattaaggggattttgtaaagatcttctttagtaatagtagaatgcttggcaagtggggccgattttttcatcattactccccattcttcacggaccggtaattcgagaaagttatatttagcagcttcaacgggttcaaggaggcatacaaggtcattgagcccttcatctagttgtcgccgaagaacatcgccatccccatcagataaattaaagactacgtttgggtagagcttttgaaattcaaaaattagtttcgttatataaggagagacactcgaaaccgctgagccgagattgatttctcccgttaatgcctcttcttgttgatgaaggtcgttttcagtttgatccaagagttgtagcatggtcgttgctcgctgttgaaataagattccagcttttgtgagctgaagacgtcgattttctcggttaaataactttatgtctaattcggtttctaggtccatgatttgtcgggaaagggtaggttgcgtaatatgtaattgttctgcagctttagtgatattattagtttgtgcaacagttaaaaagtattttaatacacgtgtatccatatggtatccctcatttttatttatattaaggagttattaataatggcaaagcaagcattgattttatattattcgcaatttggaaatactgctagactcgctagtaagattcatgaagcaactggtgccgatattgtcagaattaaggttcccgatgatactttcccactggatatggaagaaaccggaaaaatttatcagcaacaacttaagacgcatgacttccctaaactagtgactaccttacctgacttatcgtattatgacttgatcttagttggtggaccagtctggaatgaggaagttgcctcaccgattattgctttgcttcaacagcttcaagaattcactggtaagattgcgccatttagtacaggttggagtgacactggtgattatcaagaggactttatcaacaatgctggtaagctaaatgtcacgtctggctaccatattcttactcatggtagtccagctttcaatgaaaagtcattattttcatggctgcgaaaattataattcattttttgaataactcaccatttataataagctttttacattcttaatgctacagtttattattaaactaacaattaattggaggttagtaatgatggctaagaatgaacatgaagtaaaaaatgacctttttggtttcggtgataagaatgttgcgtttgcaaaatactttattggaacaagttatctcaatgggttagtatctcctgatgataacattgatgtaaatatttcaaacgttaattttgagcccggttgccgtaacaactggcatattcaccatgatggtttccaaatcttattagtaactgcaggtgaaggttggtaccaagaagaaggtaagccagcgcaattgttaaaacccggtgatgttgtagcaattcatgaaggtgtaaagcactggcatggagctactaaggatagttgattctctcatgttgctattacgaagggaactagcgaatggtgcgaagaagtagatgacgctacttacaaccgcctttctgattagttaattagtcagccttctttgtcctcgtcctcaactttgttatactaggtaaagtttgaggaggagattacatggaaagctggctttttttagcattagtattattaattgcaatctttggtcataactcatcattgattattgccacggtaatagtgatggtcctgaaactgatcccttataccgccaaatggttgcccttgatacaacataagggaattaattggggagtgacagtgatttcagttgcgatcttaattccaattgcgactggtcaaattggctttaatgatttatgggctgcttttaagacccctgctggttggattgcagtcggcatgggcattgcagttgccatcttatcaaagtatggagtcaaccagttggcagctgttcctcaagttacggttgccttagtacttggaacgattattggagtggttgcgtttaagggaattgctgccggtccagttatcgcgagtgggatgacatattgtattgtaacgctattgaatttgcatttttaaatagcaaaaaaccaagcgaggtcaaaagggatcccacttggtttttattttatgcattttctaattgcgcttgcgaagaaattttatggtatagcttagtgctaaggtatagcgaagttaatagcaggcataagcatagaaggaagccggcttgaataccgaggtgtgaggacgggttgtgaactaagtgattaacaatgccaacaattgaaacgatgagggcagttccaaaggcagccgcaatttgtcgtaacgtattaaaggtagcaactgcatcaggaacgatctcattaggtagcaatgatagtgcttgtgtttgcagagggattaacattgtcactaatccaaactgtcgaattgtttggaaaagggtaatcatgaggacagaactacgcgcaccgattgcggcttggccaattgttccgatgatatcgattatgagaccagtcccaacaagaatcttaattggataaatgtcatagaagtggccactcgttgtcgatagtaagcccgttacgattgcccctggaaggacagcaatggctgacacaaccgtacttttgcccaagacaatctgtactaacaggggaatcaaaattgcattaccgtacattgttgatgtaattagcatattaataatagtggcaaagacaaattgtttgtgtgagaagatcccaaagttgattaactgacgactactgtgacgttggttaagaaagaacagtaagagaaagactaagccgataaggacataccctgcaacattaaatgagagtaagtgattgttcgaaacatttgataagcccatcaatagtgaccataatccgcctgtgattaaaataagagctaatgtattaaagcggggatgttcattatgggggattttaggaagtaagaagaatgaaagtagtaatgtaattactgcaaaaggaataattagtaggaaaagatatcgccaagagaaaaagtgcaatagaaaaccagaaatggcaggacctaagatgggggcacaattaaaggcaagtccaataatgcccataatttgcccttttttacccggttttgcgtaacgaattgccaaaacatttactagcggcatcatcattcctgcacccagagcttgaatcatccgcgcaaccacaactagattgaagctccacgcaatcgctccgataatggttcctaaaagaaaaattccagagaaaataataaagagatttttgaaggggaatctttttataagaaatgaactgacaggaatcattagggcgttgacaagcatataaccgtttgtcacccattgaacctgggcctcgctaatatgaaagacattcatgaaggttgggagggcaatgttcattaaggttgaacagagaagaccgaaaaatgtaccaaataccatgattactaatgcatggctaatgcgttgatttttcattagtagatatagcgctccttaagattagtcaaacagtattgagtttactagccagattattaatgtcaatacacattaggaatttgcaagtaagtaaattaatgataaaatatagttacgaagaatttacatgtgtaaacgcaggagggattagatgaatattaatttagaaataactcccgctgaatggcaaattatgcgggtggtttggagtctaaggcaaacgaccagtagccaaattattgaaattttacagaaaaaagttgactggaaaccggcaacgattaagactttacttcgacgcctggttgataaaaaagccttatctgccactcgtcaaggacgtggatttatctacgagcccttagttcctgaacagcaaacaatggaccaagcggcggacaacttgtttaataatatttgtgaacgacacgttggaagcacccttgaacatgtgatcaataatgtaacccttagtaaggatgatattgctaagttacaagaattattggcaagcaaagcaactaattcaccggaccacgtcaaatgtaactgcattcctgatatgcagatgaactgctaatgaaaagctccccgcaactaggaaatctttcctaaattgcggcgagccttttttagtctctatttttctttgttttgatcctcatcagctgatggcttcttctttctaggcttaatgtaaactaccttgaatttattaacataggcattcttcaaatcaagaggtgtaaatgagaaattatcgactctaattggttggccaacttttaagtcatactgccgttcaaggaagaatccagttaaggttgttacttcagagttatcaaattgctcgatgtttgtatcaaagtaacgttcaaaatcatctaatggcatcttaccagaaacttcgaaagtaggattacccttgctatcaggatccttcttttcaatcatgtcagaggtagcatgatcgatttcttcgccaactgttccgaataattcttcataaatgtccttatcagtaatgatcccagaagtaccaccgtattcgtcttggacaacaacaattggcacttgttttttcatcatctcagcaaggacattggtgagttgttcattttcgtaaacgattggaattcggcgcatgattgtgcgaactgattgttgcgggttgatttggttttgccgcataatatcatatgcaaaaatataaccaagaatgtggtccttgtcattattagcaacaactgggaaacgcgtgaatttcttttcaaaataaagtttggctgcatcttcaattgaagccgtaatatcaataaccgctaattgtgtccgatcaatcataatatcctcagcaactttatcattcatttcaaaagctcgttgcatgaagataacgtcttccttatccatttccccagctttttctgattgttgggataaggtcataatttcattttgtgaatacgtgtcttcttctggctgaacattatatcctaacattttcgtaattgccgcagcgactaccgcaaataaccaaacgaagggataaaaaacagtatggaagaattgtaccgggtgaacaattgataagagaattggtaccggtcgatcaatcgccatatttttcggaactaaatcagtaaataccgcatggaagaatgtaaaaattaaaacaccgataactggtgcaatcgcttgaagaacatcgtgcggaatgatattaatctttagcaacagatctgtgataaattcatcacctaaccaacctaaaactaaagaagtcatcgtaaccccgacttgagctgttgataggtactcattaagatttgctaccatgtgttccgcgcgtttgacttttcgcgtttgccggagctcctttaactcactaggccgcactttaacaactgaatactccagcagtgtaaataaagcagctaacagcagaattaaaataatgataattaatttaaaccaatatgaatcccataaaccattcatcgtttaaaaatttcacctaaactttcttaaaaaatttatcgactactattgtatcagtaaaatgtagtgaaaggggagtttaattatttttttataagtgaaaatgctaaaataaaggaaaataagtaggagaagacatatgacgactaatgaagaagaaatcaagaagtcagcacgtttgcgcaagattatgcaagtgatgcgaaaatatcattttgttagcaatttttaccatcaaactaatccacaagctatttgtcaggcactgcaagaactgggacctacctttattaaacttggccaaatattatcaacccgtccagaccttgtctccccagcgtacattaaagaactacgccacttacaagatcaagttaaagctgatagttttgcgactgtagagcaaacttttgaagaagaaaccgggaagaaaattaatgaggaatttgctagctttgcggaaaaaccatttgcttctgcgtcgattgggcaagttcaccatgcaacgcttaaggatgggacaccagttgttgtcaaagttcaacatccagaagtcggtaagcttgttaatactgacttagccttgttaaggaaagcggtggtcttatttaaatatgttccgcaagacattgcagtagttgatttggataaagtaattgatgaactcagtacttcattattaagtgaggtcaatactcttgaagaagcaaaaaatggggaagaattttatacattaaataacggtgacggaccaatcttagtccctaaagtatatatgaagtattgtgctcctaagattcttgttaatgaagcgatggaaggaaaaagcattcggtatcggtttaagcagccgaatgataatgatcaagaggcaatgaccgttaatcatgaaattgctactacgctcgttaataactttttaaaacaagtttttgttgatcattactttcatgcagacccgcatccaggaaatatattaattcacgaattacgtccggatgagtcagcaaagcaatacgcaacgaccaaacaccatgaaaagaccatttataatacaaccattagttatgatcagcaggaggcattaccaaattaccggatcatctaccttgattttggaatgatgggaaggttaagtccagcgatggcaaatagtattgcgaacatcgtgattactatcaacacaaaggatacgcgaaaaattggaaaagcagttttaaatgtttgtaatcgaactggggaagttgacgaaaatgcattttataaagaacttggtgcctttattcaaccctatttttcaactggccttggcaatattgatttcgtgaaaatgctgtaccaaattgttcaattatgtaagaagaaccaccttcaaatgcggggagaggtaacgatgctaattaaggcatttggaacccttgaaagctcggttgctaaacttgatcctgaaatatcaatgcttgaggttgcccaatcgtttggccggcgttatttaaaacgaaactttaattggcgttctgcccttgataataacctagtcaattttttccttactagtaaagcaatagggaagatgccggaaaaaattaatgagttaattgatacatttgtcagtggggatgcaaaggttgacttacagtataaaaatgagcaacgagtgctaaagcagatagaacggttaatgaaccgttttatgattgcaattattttagcagcagtcatcttaggatcatcattattagtccagggaacaccagctgattcgcatatctatcgtttaggagtatccggctatattattgcaatcataattattattcttttagttgttacagagattatccatcgatggcgaaattggcgaaggaaacgatgattaatgatatatttaaacttagttaatgaattaatatgtgcgttatgctgggggatcacgattaggcttattttgatccgccatttaaatagtgaaaccaaggtggctagattcaatacatttgcgtttgttttgatggtggtcaacttggtagtagtactgcctatttttgcttttttgcttaaaaatttatctatccaatcagtaagttggctaagttcattagtagtagcgactattgacgctttaagtacgtttaacttaattttattttgtattttcagttgttgtacccgcctgcaaaaatgtcctactactgttcaggactttctggttttaggggcagctgttaaacatggccaagtcccgccagttttagctactcgccttgataaagccatcaattgttggaaaactcatcaatctgcaaaaattattgtttcagggggaatagtacagaaagcaaaagaatctgaagcagaagtcatggctgcttacttaattgctcatggaatcccagcaagaaaaataatttgcgagacccaggcactcaatacatggcaaaatttgacctttgctaggcaacttattaagccacaagagacgattgtagtagtaactagtgattttcatgttcttcgtgcgagagcttatgcaaggaagatggggttaaactggtcattcattagtagcaagacgccttggcgatactgtccattaacttttattcgggactatctcgggattatccgtgaccattggtgggtattttgcgggagcacgcttcttttacttttagttgaatttattttgaaatgaaatatgagcgagacagaaggggaaaacaaccttctctcgctcatattcactttatttattcttatatactgcaatttcaatcagattattatctggatcataaacgtaaagcgaggtcatttcgccttctgccccttgtttgacaattggtccagcaattatatcaatataataactattaagatggtgaacaatatcgtcaatactgtctccggcaactaaacataagtcagcagaaccaattgtcggattagctgcctttagcgtagttggtcggtcaattttttgtaaacggattaactgatgcccacaccgcattgtaattaagtcatcattactttgttctttaattaccggcatatcaaatacttcgtgataaaagcgcattgattgctctaaatcagttacagttaaaacaacgtgatcaattcgtcgcattttcattgtctaagtctcctttaaatttttaaatcaatatcattatacaagtttctaaattgaaatagcaaaagttgtataatgaaatgattgcagatctaaggagactttttatgaatataaaaacaataatgagcgtcgcgattggcggctttctcggtggaattacccgttatgaacttagtgtcctattaggcgacgacgggattttatatgctaaccttattggctcatttttgctagcatttataacttattattttattgagcggggactattagcagcatggctaaatgccgggataggaactggctttattggcgcttttacgacattttcaagtttagccacaactattgttaagcttgagagccaaggtgtgcttgccagcatcggttattttcttgtgagctctcttggcggcttggctttggcactgctcggttttatgctggcacgaaaatacggaggtccgcggaagaatgattaatgtaggtcttggagcagcaattggggctgtgatccgttatgttattacaagctggtggaaaaagttaagaattgattggcccctagcaactctatttattaatatcaccggtagttttttattaggcattcttaccaacaattttgctagtaattcatcgatcatgctattatttgggattggcttattaggaggttatactactttttcgactttcaatgttgagctaatttcaatgatggatgaaaagcgatggggaatgttcgctctttatttcggcttaagttatcttggtggagttattgccgcgatctgtggaatgatgatatgaaaggagtaaaagatagtgacagaaaccatactaccaacacaaattgaagtaaaaggtggaagagtccacaaccttaagaacattgatatcaatatcccgctacataaatttgtcgcaatttcgggattatctggttctgggaaaagctcattagcaatgggaattttatatgaagagggatctcgtcggtacttagaagcgctttctacttacacacgacggcggataaagttaggcgctcaagccgatgttacaagtgttaaacatattccttcagcactagcattgaagcaacgtcccgcaattccgtctgaacgagcaactgttggaacaatgagtgagatgttgaatgtaattaggctgatcttttcgcggcttggcgaaccggtctgtccaaatgggcatcgtttaaaaccaagtcttgaaattgcagaggtaatgagtaagagcggcgatgagatgggacaattaacctgtcctagttgcggcacaaagttttatgcctatggagcagaagactttgcattcaattctgacggagcctgcttacgatgtcatggaacaggaaaagttcgtgaactggatgaaagtaaacttattggggatgaaaatcttagtttagctgatggggcagttgcttcatggcatttgcccggacgaaactttatgccgagtgttgctgaacaggcaggtgttcggatccatgttccatataaagatttaacccctaaagaaaaagattttgttttaaatggtccccaaaagaagtttaagatggacttccgctctggaacaggccgcgtttttcatgactttaatgctttatacgagaatgctcatgaagcggtattagcatctgccaaaagcagtaagagcgagcgggcacaaaaacgaattagcgaatttttccattattcaacgtgcccagtttgccatgggacacgattaaagccagaattattaaaacaattagctggtggtttaaatattgcacaagttagtgaccttacgcttggagagttgagcaagtggaagcatgatgtattagctgctcttccttcagatatgaaaaagatggcgacctcattgtttaaggaatttgatgataatttacgaccattactggaattaggccttgattatttaactttatcgcgaaatgggaatacgttatcgacaggtgaactacaacgtattcagcttgcaagaactcttcgaacccaaacaactggtgtcttatatattctagatgaaccttccatcggcttacatcctgacaatattacgggtctcttaaatgtatttaaagaattagtggcccaaggtaattcattagtagttgttgatcacaatgttgatattatcaaagaagcagattggattattgaaatcggcccgggttctggagaaaaaggtggagaaattcttacggagggaacaccatcgcaaatcgctgacaaccctcggtctaagattggtccttatttaaattggacagcagtattaaaaagtcgccccatagcaaacgaaccagctagtcaggagatcacctttgaagtaaaagattattacaaccttaaagacgtccagggagagattccagttaatcggctgactgctatcactggtttttcgggtgctggtaaaactagtctaatccttgatagtttagttcccgctattcatgctcaagcaagtgggactaaattaccttcacaagttagcaaattattaagtccgttaaaggaagtagtgagtgttgatgcagcgccaatcggtaaaactaaccggtcaacagtcgcaacttataccagtattatggataatctgcggaagttatttgcagcccagcccttagccaaagaggaacactatacaccttcttacttttcttataataataagcagggagcatgtccaacgtgtgggggcgcgggggtcgtaactcttgatattcaattcttgccagatatgcaacagacttgtccaacatgtgggggaagtcgatacaataaagaagttcaaaaagttaagtggcagggatattcaattgttgatctcttaaaattagatgttcgggcagcgatgagtgtatttaaggaagtgccgaaagttgctcgtgaacttcaattattagatgaggtgggcttagggtacctgcacttaggcgaaagtacgcctagtctttctggtggtgaggcgcaacgcttaaaacttgttaaacaccttaatcataatcaaagcgaaacgttatttgtatttgatgaaccgacaattggcttgcatccccttgatgttaaaacccttttagcagtaatgcagcaattacttgatcggggagcgacaattattactattactcatgacctaaatttgattattaacgcagattatatgcttgatatgggtccgcgtggtggcagtagtggtggaaaaattgtggctcagggaaatccgttagcccttattcaaaaaccagaaagtttaaccagcaagtatttggcagaatattggtcaagatttaattaaaggtaaaggctccaaacattcggatttcccggacgtttgaagccttgtttttaatcaagttaattattttgttgctgctttttcttcatggttttgccagattttgcgaacgagtaaataacagccaattagaattaaaatagcgattgcgacaccgatcagtcgtctaatattacccttgaaaatagcatccccaccaaaggcatagagaaatgaagtcggagccatgcccacggttaccatcgccaagtagtgtttccgactaacatttaagcgggcaccagcgtagtttacaagtacactagggataaccggaatcataaaaccgatggtaagtgcaattaacggatgcttttgttgcaagaggtaatgaaggattttgtttttctttacccgtttggagaggttgattttacgaattatactcattacagtagaatttcctaaaatatttccaacccaattaatcagaaaaccaacaactggcccataacataacccagcaaagatacaaacaacggaattagacattcccggaatcgcatttaggataccgattaaagctataagaagaaagatgtctgtaaacccatgacttctaatcatatggagaagtttagccttattatgagcattaaaatctagcaacagattaatttctggcttatatgttcgataaatgaagtagagaacgatgacagcaaggataatggcgccaacgatcagccacgttttatttaatttacgctctttcataattatttttcctcctttggtagcgtaaacccagcctttttaaaaagggaggtaagagaatgtcgtaaaagcggatcatgagcgtaaagataagttccatatacaccacgcttgaataaaacgttcaaagaattcataatcattcttttttctaaactcttaatttcagctggatcagttaggtcagcacgttttttgaatgcttcaacatctgtataacgatctaaatttacttgaagttggtttgtttgaggcgtttggctaattggcggaccgataataatgccggtgtaatttaagtcaaacccttggcaggtatagattgagccaacttcatcaatggtttgaggcaattctgcccaaggggtaactgtatagttatattgatcccagggcattttaaatctgccttcctcaatgtagtgtttaccaccatcgagtgttgatggatatccagatgttgaaagaatgcgggaaagtcctacttctttattacgttgaacaattgctttcctcatttcctcagcatcactgtaaatgcgaaaatcataatgatcacgggcggatgctggtaacgcggttaatttatagttagtaaattcattaaaccacttaactaagtcatcgctcgcattcatgcgaaacatgtgggtcaaatggtaatctttatggggatattggttcgtaattgcctgaagtcgttcaggggtccagagacttttcatccgtaaaacttggtattgatcaaagacaattatgacaactttagcgcgtttaatgatctcgacaagctgattatcatggtaaaaattattataatgatcgggtttggataataaaagatgagcttcatcgataacagcaacatcaatggtttgctgttgcttatccaattgattaattaatgaggttggccgcgcaaagtcctttttatataactcttttattggtccggcaatctctttatagactttcagaatttctggatggttaacaagaaaataattattagtatgataaagaacggaattttgttgtgtccgcgcttctttttgaatgcgaacgaataattgtgataagattacgctttttccggtacctgcatccccgtagactgtatatatcgcaggatgattttgtgttagatggtgtttagtaaatgaaataatgtcattgacgagttgttcttgctctgtcgttaattttttaaatggtgaaattttgttagttgcagcgttgtctatatttttcataactatttcctttttaacgaattactctatttaatggtatcgaaatgcatgaatttcgtcaatttgaacttgagagtaatttactcaatgctttagaaagtgttagaataataagagcaataagtattactaattattaaatgtaaaatcaagaaggagtggaatagatgaatctgcatcctgattacctcttaaatgaagttaatgaaccaagcgatattaaggacatgtcacttgacgaattaaaacaattagcaacagaaatgcgtcaacttgttcttgaacgcgacgcaaaaatcggtggacacgtgggccctaaccttggcgtaatggagctaacgattgcttttcactatgtctttgattcgccccacgataaagttatttgggatgtttcacaccagagttatgcccataaaatgctgacaggccggaaattaagttttctcgatcctgatcattatgaagatattactggatttacgtcaccagaagaaagcgctcatgacttttttgagatcggtcatacttcaacgtcaatctcccttgcagtggggatggctcaagcgcgtgatttgatgaagccgcaatcacataataacgttatggcagtaattggggatggatccttaagtggcggattagcttttgaaggattaaacaatgctgctaagcttaattctaacttgattattctcgttaatgataatcaaatgtcaattgatgagaaccagggtggtttatacaaagggctaaaagaactccgagatactaacggtgaatctcccaataatatttttaagtttatgggtctcgattacaagtacgttgcagacggcaatgacttgcagacgatgatcgacacttttaaggaaatcaaggatattgaccatccaatcgtccttcatgttaacaccttaaaagggaagggttatgagcctgctgttgaagaaaagatgaagtatcattggcgcactccatttgacctaaagactggtgaagataaggttaaagcaagtggagaatcgtatagcgatgctgtccttgctgaattagataagcaaattgcagcggataagccagttgttgctattaatgctggaattcctggtgcgtttgatcttggtaaatttaaggctaagcacccggatcgttattatgatgttgggattgctgaacaggattcaattacgactgcggttgcaatggcgcaagcaggtgcacgccctgttgtgtttcaaaatagtactttccttcaacgagcatatgatcaattgattcatgatatggcattaaatgatgctccggttgtaatgattgtgcgaggcgggtcaatttcagaaagttctgctactcatcaaggaacatttgatatttcaatgattagtgatttgccaaacattgaatatttagcaccaacaaacgtcgaagaaatgatttcgatgttacggtgggcaattaatcaaactgatgaaccagtagtaattcgtcaaccagaaaagccccttcttcatggaacaccaacacaagatgactacagtacgatcaagtacgatattgctcatcgcggaagtgaagttgcaatcatggcagttggtgacttctgggaacttggtgaaaaggtaagaaaggaacttcaagacaagcttaatattgatgctacattgatcaatccaaagtcggtaactggaatcgattctgatgtccttcaccacctagcagaaaatcacgatgtagttgttacactagaggatggggtccttagtgggggcttcggggaaacaattgctcgttactatgggccaaagggaatgaaagttttgaactttggagcaccacgggaatttgcggataatgttcctaccgaagtactatatgaatggtatcacttaacccctaaacaaattgtggatgatattgagcaggttatccattcactataagttaacagagctatcatcgcaggtaaggattacttgtagatgatagcttttttcgatttaaaaaatgcgaattgcttctttttacgtatatatattaaagagtatataaaagaggagcgagataatatgaaccatttaaaccaccttcatgtattgcgaaacacttgcttagtaggcttaacgacagcgtcaacgatcctttcgctgtcgttaaatattccaccagttttagctgcaactcaagagccaattacgcatcccgtatctaacacaaataatcagaaagaacgtgtccaaatcaaacgtgtaatttattttcatctcttaaatgaagttaaaaaagtggaacaagtgtcttatgctcaccgtgaagtaccgaatgattcaaccaaaaaggcaaattggattattgaaccttttgaagaagttaatatccctgagcaagctggttttagaccatcaatggataagattccaactgttacagaaatagaagatctatcgcaattaaaaaatacgataaatgtttattatcagcccctcaataaagatgaagggccaaaaaaggacagcaaagagaatacgttagcagaaaagactaggggtgagcaagtaaaggagaataaaaaagaggaaaaacaagattcgcaggataattaccccgtggtagaagatctgggggatgataatcaggtcacggaaaattatggggaggtaaataatacaagaaagcagcaaaatttgcatcaacgggtaacagggattaataatcgactaaatcgttcacatcgggactcacgtaaaaacgataactctgaccaacaaatacttccacagacgggaaatgagaccgataatttaacgacttttcttggtttggggataacggtaatggtcgcggggatgagtcttttttcgttaaagaaagcgcacaaaaataaataaaacaaaaaaacttgataaaaggacttgcatttttaattttctaatagtattctaatgttattgaaaaacgaatggaggaaactaaaatgcaaatttacaataaatcgattattcatcacctaacctccacctcaaccacaacaacaattaccgtggttgagtagttttaatatctcttaaatctgttagcaatagctattcaagatgcctcaaccacttatcaaaacttgacgagggttggctagggacattttgggtagcttttttatttaaagtgaggttagaatgatggataatcagaaaaatgaagttaaattaaatcggacaatgactcccggacaaatggaaatgattgcaattggtgggacaattggtagtggtcttttcatgggagccacatcaactattaaatggactggtccttctgtcctattagcatatgcctttgtaggtttagtcctatatggtgttatgcgtgcgttaggggaaatgatctatatcagtccaggaactggttcctttgcggactatggatctaaatatattcatcccttagttggatacctgacaaagtggagtaacgtctttcagtttatcattgttggtatctcagatattattgccatgagtcaataccttaattattggtggcctaacttaccagactggatttctggattagtaatgatcattatcttaacgcttgcgaaccttgcatctgctaaggcatatggccggttggaattttggtttgcgatgattaaagtcgttacaattattgttatgatcattcttggattattggtaattgtccttgggttgggtaacaattggcatccggttggaatttccaatttatggtcacatggtggattctttactggtggattcatgggattcatgttctcactatctgtgattgctggatcataccaaggaattgaattacttggtattactgctggtgaagcggcctcaccacgccatgcgattgttaagtcagttaaatctgttatttggcggattttaattttctatattggggcaattttcgttattgtttccatttatccatgggacgaattaaaggcagttggatcaccattcgttgaaacatttactaaagttggtattactggagcagctggaatcattaactttgttgttttgactgctgcattgtccggtgccaattcaggaatctacagtgctagtcggatgctttttaagctttcagttgatggtgaagttcctaaggtatttagtaaattgtcaaagcgggttgtaccaaatgttgcgattttaacaatttcattctggattttccttggttttattgttaacatgcttctatcaatgtttaatgcagcctctgctaatatcttcgtgattgtctatagttcaagtgtccttcccggaatggtaccatggtttattattttgatttcagaattaaacttccggcgtaataatccagctgagttaaaggaccacccattcaagatgccactttatccagcatataactactttagtttgattgcgctaagtgttatcttactgtttatgttctttaacccagatacacggatttcggttagtgttggggcagtcttcttagttatcatgagcattatctacaagttaagaactcagcgccaagataaattagcataaagaataagtactctcgaaacagattgttttgggagtattttcttttatcgcttaaaatgataaaatacttttacgaacatacgtttaagaggaaaggtattttagaaacatgcgatttcgattcaataaaaagacccagtatttacttttagctttagtagcgattctcggcattggtagtttttcccagccatctgataaaggaagtaccttaccgcagggaatccaacgggtagcgccttggcgtcattccagcaacaataatcgatcatcttcttttacgccgccaacccaagagcaggccacgagtgttctttctaatggcgtccgtcagcagttaggaacatctgacataaaatggaatggttacggagcgtttattttaaataacaatcagacggcgctgaacgcaaatattaataacgcgccatacgcagttaatcgacgtgattcgcgtggacgagcatggcagggagacgcctggctcaatcgtacaacacgccagtatcgtaatcggaatgaaactgggaatggggccactaattggaagccagctggatttttacaagctcataacttaaaaggtggcatctcccatgcttatgatcgcggacacttacttggatatgcattagtagggggtatccgtggctttaatgcttcggagtcaaatcctgctaatattgcaactcaaactgcttgggccaacgaagctcgaagcagtacatcaactgggcaaaactactatgaaggcttagtgcgaaaagctcttgaccagaacaaacaagttcgttatcgagtaacagatgtctatgatggtaataatttagtgccttctggtgcccatattgaggccaaatcaaaggatggcagtttgcaatacaatgttttcgtccccaatgtgcaaaataatattagtataaattatgcaacaggggcagtaacgcaagtgaacacgaattaaaaaactatgtagttagaataggccctcaatacttcatttgattaaagtattgggggcctatttatcatctgcatataaaactagcgtagaaacaaaatatttcgatggtcacttgcaaaattggtttaaataaacgaaaataaaaagagttaatattgtttagaaaaggactacgccaatgacagattcagatctaaaaaagattcatattgtttttaatggtcaggatactccaccattaaagattagccagctttttgatgctaataagttcaatcgtttaacagcagttactggtaacgtgactgccgactttattaatcagtatctaagtcgattcattaaagtcgaagttgcactgagcagccctgaaaattatgaagcgaaaactggtgatgaagtaatcactaaggtagctttaactaatgcattgctatctgctgctaataaaaagcctgctaaagtctttgaagcattaactagtgacaatcaagcaaatgtgttgaacaatctttttcaagttgcaatggcaccaacccaggctatccattcacgtttttacctcctaagtaattccgagacccatgatactcgtgtgattttgggaagtcttaacttggacagtgcttcatttgataaagagcgtaaccaatatgaagaaatattagtctttgatgatgacattcggctatttcaaaatcttgataaccactataagaatgacatcaagccagttttacgaccattttttactgaaaatcttttaaatgcagcgcaaaatcaaattgatgagagcttgaaagatactaaaggaactaagaatgcggttgtaattcttgataatgaagttactgatcaaatcgcagcggcagatatgaccgacttgattagtcatgacgttcaaaaacaaattgatgaaaataaaattcccgcaatgattactaagtcgatgcgagatattacgactaaccgctctcaagataaagaagaagcagaacgacaaattcaacaacacgatacaatttacactttgcaaaaaacagctgtatcgccccgagcagctaagccaaaattgaaatcgcgcgaaaagatttttaaacaagttcaggatgcattgattagtggtatgacaccacaacaacggtcagcagagaagaagtatacaacgttcttatatgatcgtccgatggaaagaaatctggttaacaataatagtggcctgtatgtaccgaatgatactggcacgcacccaattcaatttgggaagattgcgactattagtcaaattcgtgatggcttaaagagtattgatgcagtattaaaagggtatcagcaatatgttgttgactacaatgatgattatggcaagcgattctatgaagctattttatatagttttacggcaccatttttatgggagattcgtgcgaaagctagtttgaatcctgaagatggtaatgatattcctaacttcttgattctaggagcaactgctggttctggaaagtcaactctgttacggattattaatcaattgacatggaatactgatcggtcattaattgattttgggactatctatcctacagatacaccgcagaaaaaagcaaaaactgttgatgcaatcgagcactacatgaagcttggaagttcataccccgttttaatggatgagattgaaccatacttcttccaacaggatcaatatagtcggcacttagttgttgatacaatgaatgaattggttaacaatccacatgcaattgcgccattaatcggaacaactaactatgattctggttttactatgctacgtgaaactgcacgacggacttattaccttcaaattgataaggttattgatgaccagcaaaaaggtgaagccaataagtatatctataacgtacgacaaaccctaaataatacgctgtttaaagactttgtaatgcgaatggcaagtttactagaagacgatgaaacgccatggcgcgcatttgatgaaaagactggtaaacttgacttcttagcaaatacccgtaaaattttccgcgattactatcaaatggcggatatggaagtacctccttactttgcagatgaaatctgtgatgactttaaggaaagttcgcgtaaccggtgggctaagctttacctaacacaagaagaagactttaaataccgccaacaagatcatagcttgttatttgatatttcgaagcttaatacttttaatggttttactgccgatagtattgaaaagtaccggaatgcattgccaattgaactctgtgtggatggtatcaatggcaagcgtggcaaatttgtggaaattaaagctgatgaattctttaaatggattggtgaacgtaatccatatgctgaggataccgcggaaaacgaagcaaagaatgaggaaacattaactgtgaatacagctgaagaagttacggaatcgcctgttaaagaacaaaagaagggattctgggcacgattatttggctaatcgagtaggagataattgattagttcaattatcgacctctcacaccaccgtacgtacggttccgtatacggcggttcgacaacttaatcactttgaattgactggagcgtcttggacatattcataagtccgagttgttccagttttctatttgttagagaatagctcaaggtcttactgtgtgcagttcgccagtagcccttgcgggtactagcgaagacgtatgcatcacgctgggacagccccagcttctgtaagttagttaccttagttttaagcttcttccattgcttccagatatactgtcttattcgggccctcaaccacttgtcaaggcgttgaataaagtcagttagtttcccaattgagtagtactgaagccatccacgcatttttcgctgaatttcttcaaacattcttgtcagagatattccacgattacgtttagttaataacctcaatgctttctttactcgttgttgcgattgttttgctggacgggcgtaggctccattgtggtctacacccaacgaaaagccaagaaactttaaccgtagcgggctaccgactttggttttatctgggttcactttaactttcaatcgcttttcaagaaactgggtaatgcttcgcattactcgttctccggctcgttgacttttaacataaatgttacaatcatccgcatagcgcacaaagtggtgaccacgtctagtcaactctttatccaactcatttagatagatattcgccagtattggtgacaatggccctccttgtggggttcctttttcactcttagcgaaaagcccatggtctaagactccgctagttagaaacttacgaatgagccttagtgtccatgggtcatcaatatattgttgaagatacttaatcatcaagtcatgattaacattatcaaaataggcttttaggtctaagtcgacaactcttcgataaccttgattataaagatctactacttttgcaatagcgtcgtgagccccacggtgagggcggaagccaaaactattatcagagaaaacacgctcaaagataggtgtaagaatttgggccacagcttgttgaaccattcggtccaccactgttggtattccgagttttcttactccaccattaggcttcggaatttctacccgtttgactggtgctggtttatacttgccctcacgcaaactagcgatcaattccgtcttattttctctgagatatggcagaaggtcattgactgtcatatcgtcaatgcctgctgcccctttatttctcttaactcgcaaataagcctgattaaggttattgcggtccaagactaagtcttggatagtgacactcatacctttaccttcaccataatcggtactacgcgcccttgtgtactttcggttttccaaacctatcctcgacaagcggtcagcttgttgttctgttttctgcgattgtcgcacctgattacacctccgatataagttacaagttattgtcgttcagtccttcatctgattactcagactactatgacctcggctgacttctggcttactcaacgctacatcactgcaccgcttgtttctgtggaaattaaacttattcctcttgtcggaaacgtgtaggccagatctccccgggtaaggatattaactttcgtaccatgtcaccggtagctttactgaaagtaacttcgagtagtgttggactttaacttgtcatgcagtcttatccagttagttccagccttatagctacttcttgttcatcggtgcagtactttgccttagacttccttcagattccacctcacagtggacacccttgtcctcagctcatggttccgactactacggcccatagcggactctcaccgcctagctaatacccatgccgggcgcacatataaaaaggtctgggacgcaaatagcattcaagacctttttatttactattaattttttgtgccttttgtttcgggtgatgtttcagattttcaagccgatttaccaagggttttgcatattttatgtagagtggattacgaaggagccagttatgaaaacgtggtgaaattttagtgatacaccatattgtgaggaggaagaatggaacctgcggaattacagggaggagcatcccaattatcccaccaacgaatgaaatgctccctaacaagatccatccaagttttaatactaattttatgatcattaagaactcctcctttctttcatattaaagttactaccattctatcatgtgcgaacgaaaaaagggtggggagctgcttaagtttttattacatttaagttaaggagagaaataaattgacattttatacaattagctatttatcaaaccaccaacatatgaatcaactatttaattatattgctattatcatctttgtccttctgattgcagtaatggcatttttatatttacggcatcgccttattacccgttatcgtgatttagggataattttctttttactattgttgctttttatcggctttcaagttaccgatatggaaaaaataccacacagcaatcccaaacaactcagatgattccctttattaaggcggttgctcgggatcataatgtttctccacaaaaagtagttgttaattccacaactttaacggatggaattcttgtccgaattgaggatcgggattaccgtgtcaatttaagtcaaacaggggataattatacccttacacgagcacatgttgttaatcatcaggttaatttaatgaagtaggagagaaatatggataattattcattgattattataaaatttgttctcggaatgttatgtttgattttgcagattaatttactggggaaggggaatctcgcacctacttctgctattgatcaagttcaaaattatgttttaggtgggatcattggcggaattatctacaatagtgatatttctattcttgagtttataatggtccttttgatttggacattaattgtatttattgtgaaatttgctaaagatcataatatttgggtaagaagaattatcgatgggcgcccgcaaatattaattcagaacggaaaattattagtagagaattgtatgcgtgcaggaatcagtgctaatgatcttatgtttcgccttcgtggtcatggaatctatgaagttgctaaggtcaaaagcggaattttagaacaaaatggccagcttgtaatcatcgaaaatgatgaagcaaatgttcgcttcccattaattaatgatggacagatcaatattgatgtaatggaattgattcatcatgatgaacaatgggtatttgaacaaattcataaagcaggttatgacagtgttgatgatatctatcttggcgaatatattaatggcaaattaactttaataccatatccaaaagcttaaaagatcatcctctttataattttcaagcgtataataagagtaaaatacaaaatgaaatgataagaagatgatttgatgaaaaaatcgttaaaaattgccggaattagtattggtagtctaattcttcttgcttttggtattcaaggtttcttattacgcggaactcctggtcagcacctttcatcacaaaattatcaaagtaacctggagtattcttctattcccaccttgcttattcctggctggggtggaagcacaattacttataataagatgattaagtactatcagcaaaaaaatattgcgcaaaaagttttaacgatctgggttgctcctaatggacgtatctggactgagggggactttcacgggcaaaagaatgccttaattcaagttttatttacttggaactataatggtacctaccatccacagatcaagcaattaacgggtgttctaaattatttgcagaaacactatcatatgcagaaaattaatgttgttgcccattcatatgggggcacagaattcattcacgcttatatgggttcgaaatatcttcaagatcatatgcggttaaataaagtagtctttttaggggtaccagttgaagaaagccttagcgatcaattaaaatatcgctatcacttagttaataaatcgacggacaagaattttcaccaattatttttggagatgaaaaattggcaactgaattatcctgttgaaatttataatttaatgggtagtgaagaaggcagtaaaacaactgatggtgctgttccgcatatccaatcagaaatgttaaaatcattaattaaagcccatccatcaattgagtatcatcaaaaagtgtatccaaaaaccactcactatcaattacatcatcgaacaaaaattttaaacaatatcgctaacattttatggggaaggaattaaaatgaataaagaacatggccaagtaacaggaattatatggcgtggacctgatgacctagctatatatcaacgattaaaagaatatgcagataaaaaagacatttcagtttcagaggcagccaagcaattagttaagatagctctcaagaaagattaaaaaatcctaattggttaagtttaatattccatgatagaatcttaaatgtacaaaaattaaaggggagttcacttaatgataaatcaaaaaagtaagacagtatatttctgtgccgggtggtttactgacaagcaaaataaagcttatgaggatgcaatgaatgcaattaaggctaaccctacagtagatgtagagaattcttatgtgccattacaacaccaatataaaggattacgggttgatgaacatccagagcttttgcaagatcgcgaatggagtacagcaacttacaatggtgatcgagtaggcgtttcaacttctgatatgcttttagcagtctacattcctgaagaagaagatgtaggaatgggtgttgaattaggaatggcacgcgcactaggtaaatatattatggtagtgattcctgatgaggactttggtaaaccaattaatttaatgagttggggaattgcagataatttcattaaaatgtcagaacttcctaattacgattttaataaaccatcttataatttctacgatggtggagtatattaaaaaagatgtgcgagtttcaaatcgcacatcttttttacaaaatgttagtttacataatatctataacggttaataaattgatgttcaatctctgacaatagcccagcatgattgttatcgtatcttgtaactttatcagcaacttttagcaggtcagctgtagcgtttttcattgcatatccataaccaacttctgataacatctcaatatcgtttgaagtatctccaaaagcaactacttggtctagagttccgtttaagtaattttcgactagtctttttaatcctaaagctttatttacgcctgctggtaggatatcaatgccataagctccactataagttgcttgaattaagtttggaaactgctcatttaattgatttacatatccttgaataatagtttgggataatttgcgtttggcccaaccaatgtttaagttataaattggctcagtgattttttgaaggtcagaaaaatatgtgtggtggggataaaaagggactggaacatcgcgatactgctcggcaaggattgtttgtgtttcgccagataaagataggatgtcagggctagggaacgtatgcttaataaaagtatgaagctgttgcagcgtcgcaattgaatgagtcttgccgtagacagatttaccgtttattatcagtcgcccgccattttctgctacaaattcttttacaagtggacaaggctgaaagatcgttgacaatgcatcgtaactattcccgcttgcaataataaagtggtagttttgctgttgtaatagttcaatatctttattcaaacggttaatgtcgaatttatcattatcatctagtaaggtaccatcaacatcgatagcaataaaacggtattttcccatttgatttcctctctgaaatattaatttgtagaagaatcttgtggcttttctacagtagttttacttttaagttgttgctttaactgtgtattttctttttgcagttggtcaatctttttttgatacttttttaattcgtccttactaacacgcgatgattgtaattcttttaattgcttgttagttttgaggtgattagaaaatgatagcaagtaaataataatagccccaataagtaaacagataaagattagcagcactagtggcatttttacttgtgctccaaaaagattgactactacagttgctgtatttaatagtgcaaagatggcaattataattagaataacgattgaagcaatagttgtggattgctttttcatggaaaattccccctcatgttttttgtaacatatctattatattaacttaagaagtgctggtaaaggagaagaggggaataaataagcgtcatctgtatttgtactttttaaataaaattgacaaattatctttatttttttaataaatgcgctaaaatagaaatataaggcgtccttagtgtaatggatagcacatgagatttcggtcctcatgatccgagttcgactctcgggggacgcatttttaagaaaatatgatgaaacataaaaatcctacaatcgttgttatatcaatgattgtaggattttttagtattttagaaaagtatgaaaaaatataaaaaagtacaaagtcggtacacctttggtacactagtgtaccaaactaaagttgattcaaagcattgacaattttgtcatcagtttttcctttgtattcatctattaaataagcgtaagtattcattgttgtacgaatgtcactatgaccaagacgtttgctgattggatatatatccacacctttagcaagaagtaaggcaatgtggctgtgccgtaaactgtggaagtgaaaattttcgcggtgaatacctaatttatctaataattgtcgaagcattttattgactgcgttgctagtaggaatagtaccaaactgagtcataaataccatattactaatatgcttttccttcaattgagaaagcaattgtagaagagtttgatttactttgatagtccgattagacgattatgggttgcttactacaagtattctcaaccactagatgcctttagtcgtcacgttggctatgtttgaattcgtcaaccacgagaaaacggttatggttacatggctgttcgtgatactaagactaaccaaccttttggaaaatttgaataaaattttagttagccctaatggtagttgcaaattttagaatgcaattactactagggctttctttttgttgtataataaaacagcgatagtaaacgaattaccaccgctgaaataactatttgcctagccacaagggctagacacgcaaccatgcaaatagttgcttaatagtctttttgattatcttttttatgtgcttattaggcacaatcaatattactatgcaccaatgatgcaattgggacacctcccaacttgcacatatttgtggagtgattagttccaacagtgtgctcaactattgtatcataagttagttgtgttataatatatgtatcaatattactatgccggtgtgcaaaatggtttcagttgattacttaaaccgtaccggtaagcagggtgccctaatcggcatcctttttattttatttagttcgtacacgtttggcacactaaacctcttgaaacgttggtataacaacgcttttaaactctcggggggagtaagattgtataaaaaagaagctccgataaaacgctgatataacggcagtttatcggagcttttgtttagttaaaatggtgaaagtttgtaagtttggtgcacaaatggtgcaattcggcaatttttgtgcaccaaaattaatcattgtcgtaaacttattttatttagttgagtgcgcgggttctttcaatagaaaaatttttgattatttcgagaaaatttcgcaaagtaaaacaaagtaaaacaaagtaaacaaaagcaagataaagcaatttatttaaaaatgcgccatcaaatcaagatgctacaagctcttggtcctgtgttacataccccacaagcaaaaaaattaaagggttataggtatcaactatgggagttacgacctatgctgaaaagagtattttatggagtgtggaagaaaaataattttgtgttattaaatcattatactaagaaaaaggatgaaacagatcctcgtcagatagaaagagccttgtcgctacttgacgattggtacgaaaggaagggtaaataatgagaaactgggaagatatagataagcatcaaacggttgcaacaaaagaagaattatcgattattgataccttgtcttttttagaagtacaaagaattaaacaggggatttcgcaaacagaatttgcaaaaaaatcggtatgacacaacctcaattggctaaaattgagaatttagattcaatccctacgctgcctacattaaataaatatgctgctggattaggtttgcaaatcaagttgtctatttctccattgatggaagccaagtagataaatattaacaataattgcaccgtgaaataatttcataatatgcaaaaaaataagccccgataaagtggtgctatatcagcgctttatcggggcttttattaatgtctttagacctagttgagtgcgcgagcagagcgagtgcacgaaacaaaaaaccacctgctatgcgggtgggcgataaaaattatataaaaaaggcctcttttgccttaagatgtaggtgttcaagccaaagtcaataagggaaaagaggttatataaatatggctaataaattaaatagcttagcccatacgaagtggttatgtaagtatcacatcgtattcataccaaagtatagacgtaaagcgatcttcaatcaataccgaagagacctgagagattatattcgtttgttgtgcaaatataagggagtagaaataattgaaggtcatatgatgccagataatgtgcacttgttagtaagtattccgccgaaactaagtgtctcgcagtttatgggatacttaaaagggaaaagtgcattaatgatgtttgatcgacatgcaaacttaaaatacaaatatgggaaccgacatttttgggctgaaggctactatgtgagtacagttggattaaatgaatccacgataaagaagtatatccgagatcaagagaaacatgatatagcaatggataagctaacaagtgtggaatattcggacccttttaagggtaagtgaggtagtataaacaccgcttaaagcggtggcaaagtagtcagagcattttggcttgagcaaagcgaaagccagcgccttgagacgccggcttttattatcggcttatagccgatgtgcaaaccacccgtttgacgggtggttatgatttaaataaagagcggttaatcttgttaaatataattaataaccaactattgatttagagaaaaataaagacgaaaaatgatctatgaccgagttaaatacttatctaaaaagtccatcacaatcttaaatacctgtggttgaaggaatttcacatccatgtgacttgcgccttcgatttcgtataattcagcaggaacgttgttttcaactaatgcatcataaagcttttcactatctttaattggaacaacgacatcttctgtcccatgaaagataagaaagggcgtagaattagaatttacataggtgaggggatttgcggcagaatcaagctcaggagcgttttcaggctcagcaccaagcaagttacggtaaacaaaatcaaaatcgtttgatgcacttcctgttttagcggttaagggatcaaccacaccataaaaaggaactgctacttgaacatcactggagtaatctaaattagcacctttgtcaaattggttaaggccgttagtaacacctagcatacttgccatatgtccaccggccgattctcccatcacaataaaccgattaggatcagcttggaagcgcttggcattagctctcatataacgaatagcagccttagcatcttctaattgcccaggaaactgaactttgttgctatcacgatattcgacgccgacaacaatgtaaccatgccgagcaaaatcaaccaaattcggcagatgaacattgtggtcagtatccatccagccgccaccagcaaaccaaaaaattactggataacgtgtatcatcattagtttgaaaatgtcgaatgactgaaagcttcaaatctcgcgttgtattaccaagccatccaggaacttgcgtatacgtaatatctgaatctagccataaaccgtcacgtacttgatcaactttaagcgtatgtttcatgataaaaactccttttaaaatacttttgccatagacttcagcaatagtattacataaatcttttaaaacataaatcaaaagtattagttttattaaagttaaaaataagcattagataaattcttttgagaaagctaaaaattgatattctgggggaattttaaattcagtcgcattaaaactataattttaatgacaggttaattttaaaataaatcgttccctctttacgtatttactagcaacttcgcttattttatggttagattaaattaatatatatttataaggagcgatcatctatggaaattcaatactgggctgatattgcgtgcccatattgctatatgggaattacacaattacaacgggcacttaaagaattaaagattgccgatcagacaccattaaaatttatgtcatttcaactagatccaacgttgccaacaacaactgatctatcaatgacagaatattatgcaaaaactcatcaactaactaagcaagaagctgctacacaaatacaaaaaattgatcaacttgctgccgatattgatttaccaattaagatggaaaatgcgattcctgttaatacattaactgctcatcgcttaataaaatacattgagagtttaaacgaccaagcattacttaataaggctgttaaacgcctttatcaactttattttaatgataatgaatcaatcgcggactatgaagctctaactggtgcaatgaatgaaattggattacctgttgctgatgttaaaaaagttcttgaatctaatcaatatgaagatgaggttcgaaaaaacgaacagcgcgcatttatgattggaatgccaagtgcaccgttatttgtgattaataataagtattcaatcactggcgcgcaaccttacgaagtatttttagaagccttgaaaaaagtaaaaaatataactaaataggattcaagcaaatcagaagataatttctggtttgcttttttgttccccctgctctatttgtaaatagaaaaactgtaattctttataaattctaatcatccgggtagaataagacttgaggaggtctttagaatgaaggtaacaaaacttattgtaggaattattatgattgtattagccattattatatttgttcaatcgattgttagaggttttgggaatcctaatcctgcaattcatatttatgccagaacagccgaattaattgtttcgctattatatctggcatcaggaatcgtctatatcgctacttgtggtattgatggtttaggtggcgatattgctggattatcgatgatgctaatcagttgggttttaggtttattaacgtgtactatctatcttccattgcaactatgggcatggttggcattaattatcggagtcggcttctttgtctggcatattatgttacgacgtgaataaattatgctaattattgggcaatccaatgatattcgcttttagcctacgttattagattgcctattttttctaataaaataaaaaaacagcgagtaattttacttactgttttagactaattgggctagctggattcgaaccagcgcatgacggtaccaaaaaccgttgccttaccgcttggctatagcccaattatattaaaatgttgaacaactattaaaattgctcaatggaggatacagggctcgaacctgtgaccccctgcttgtaaggcagatgctctcccaactgagctaatcctccaaaagtgacccgtgcgggatttgaacccacgataccagcgtgaaaggctggtgtcttaaccacttgactaacgggccatattaaattaattaaaagcgggtaacgagaatcgaactcgcgacaacagcttggaaggctgtggttttaccactgaactatacccgcatatcagcgacgaatattatattatcaagttatcctataaaaagcaatacttttttcaaaaaaagtttgttttatttcaaaaactaattaatggctactttagtaccgcttgttacaaagtaaaaatcaagttttgactacaaaaaaacagctaagaagattacctcttagctgtttagccagatcgggaaaacaggattcgaacctgcgaccccctggtcccaaaccaggtgctctaccaagctgagctatttcccgaaatagtgccgaggaccgggatcgaaccggtacggttatcactaaccgcaggattttaagtcctgtgcgtctgccaattccgccaccccggcataatagaactgactaagcggaagacgggattcgaacccgcgacccccaccatggcaaggtgatgttctaccactgaactacttccgcaaaagtgacccgtgcgggatttgaacccacgataccagcgtgaaaggctggtgtcttaaccacttgactaacgggccatttttaaatatatcaaacaattttttcaaaattgttaactcgtctttcacaacgttattaataataccaactgatctataaaatagcaagaactttttttaattttttctaaaaagttcttgctattgttatgttttccttctaaaagacagcaaaaagactgaaaaaatctcatttctcagtctttaaaatttatatttttaaatcaaatgtacccccttatcaacataaatggtgtcgccagtaaccccagttgataaatcgctcattaagaatgcgcacacgttcccaatttcgctaatagttacatcttttccatcaacagttcttgcttgggacatctttaaaaggtcatcatgacctttaatacctgtaactgctaatgtcttaaccgctccagcagagattgcattaacacggattcgtttttgccctaaatcccgtgctaaatagcgaacactagcttcaagggcagctttagcaattcccattacattatagttaggaatagcacgttcagagccaaaataggttaaggtaacaatacttgcaggattatttaatagatctaactgattagcaaccttagcgacagcaataagggaataagacgaaatatcttgcgcgattgcataacctttgcgactagcaccaaggattgaaccagctaattcttcttttttggcaaaagcaattgcgtgtacaattccatctacttttgtaaaacgttctttgatagttgtaaaggcttgttcaatactctcgtcatccgctacatcacattcaattaattgatcttcatcatctactaaccgttgtaggctttttttcattctggaattctgataagtatagataatttgggcaccttgttcagccatcatttgtgcacatccccatgcaatagaacgcttattagctactcccataacaacgatcttttttcctgttaatatatttcccatattatcctccttaaaactttcgataacgtttttttctatttgctagaagttgatttgacgatagttcttgcaatttgtttaatctctttagtaaaacctgctcgatatttttgcaagtttgttggtgcttttcgctttctggaataattccttcaataatcccttgctttaataaagcttgcggcaccatttgcattaattctgccgctttatctgcttttgtactatctttccacataatggaggcaaacccctcaggagataaaatagaataagtactgttttctaacatccacacttcatctccacatgctaaggctaaggctcccccactacccccttcaccataaataatcgtgataattggaatagcaagctgacttatttgtaaaatattttgggcaatcgcactaccttgcccattttcttcggcttccttgctaggaaatgctcctgcggtattaacaaaacagaatacaggtcgcttaaatttagctgcttgcttaattaagcggagtgccttgcgataaccactaggcattggtgagccaaaatgctttatgattttttcttctgttgtttttcctcgatcagtggtaatgacggtaactgcttgctgatggaaagtagcgattccaccaatgattgcaggatcatccccgcctgcccggtcgccgcgcaactcaacaaaatctggaaaaatattttgaataatctccatccccgtaattttattgtcgttgcgagcacgtttaacaatctcgcttgctgataattgttcattcattagcaacgctccctgtttttaatagccattcaagcagctttttttcatcttgacgttttacaattcgatcaataaatccatgatgcaggatgttttcagctgattggaggtcgataggaatttgctggtggatcgtctgttcaataacgcgacggccagcaaagccaacaagtgcatggggctcagcgagaataatatctccgtccatcgcgaaactagcagttactccaccagttgttggatcggttaagaccacaatgtataaaaggccggcagcagcatgctcatttattgcttgtgaaaccttagccatctgcattaacgacataattccttcttgcatccgtgccccgcctgaagcagtgaatagtactactgcttgacgatgggtagttgcatattcaaataagcgcgttatcttttcacctgtaacagttccgagtgatcccataataaatgttggatccataatgcctagtgaaaatagctgatcattaattgaagcttcaccagttaggactgaatcattcagcttagtttgtctttggagtttactaattttttcttggtatccaggaaaatgtaacggattctttgtctggagatccttatcgaattctttaaatgaatccactaaccatgaaagtcgatggcgagcaggtattcgtaatccatagtcacagttgggacaaacagcatattgtgttaactgcttggcgaatagcaattgatgacaatgtggacatcttagccacatttgatctgggaccctttcatcagcatttttatctgctttgatgtgccgttcacttaaagtattattttgatcatataatttcacgctgtcagccccttcttccattgtggcaagaaagagtcttcaagaaacgttgttgaagctgttcctgccaaaaatttaggattgtttaggattgctaaatggaaattctgattggttgttacgcccataattaccatttcattcaaaagtcgtttgattttttcaatggcttcttggcgatcttgaccaagggcaattaccttagcgatcattgaatcataataaggagtgatcttgctgccaggataaatagcagtatcaattcgcatccccaaattaccgactggaagatacaagtaattaatcgtcccagtcactggcataaagttttgcttaggattttcagcatttatccgacactcaatcgcatgtccatgaacctgaatatcctgttgggtaaagggaagtggttcattcgcagcgacaataacctgtgctttcactaagtcaatcccggttaccatctccgtcactgtatgttcaacctggatacgagtgttcatttccataaagtaaaagtgatggtccttgtccattagaaattctattgtccccgtattatgatagttaatcacattaatggctcgcatggtaatttgtcctagcgtttttcgctcttgttcatttactaggacacaaggactttcttcaatcaatttttgtttattccgttgaatcgagcagtctcgttcaggaaagaaaacagcattgccaaaattatcacgaaagacttggacctcaatatgtttaacattctccataatcttttcaaggtacattcggtcatcgttaaacgaaagacgggcttcgttttgggcctcgctaaatatttgccgcatctggttatgatcattaattcgtcggatccctttaccgccaccaccagcagccgcttttaacaaaattggatacccaatcttgtttgcaacctcaacagcgtcattaacattggtaatatagtcatcgcttccaggaattacaggaacccctgattttttcatttgctctcgtgcgtgctccttgtttcccattaagtcaataactgaggcttggggaccgatgaacgtaatgccgcattcttcacacattgtcgcgaattccgcattttctgatagaaagccaaagccaggatggatcgcctgggcacctgtaccaagagcagcttctaaaatatttttcgcattcaaatatgaatcttgagcacgggcggttccaacgcatacagcttcatccgctagttgaacgtgaagactttcgcggtctgcagttgaataaatagctactgtcttaattcctagctcccgtaatgaccgtattatcctgacagcaatttcaccacgattagcaactagtactttggaaaacatcaaaccacctacccaatcataaaagttaattcagctgtacaggcttttttaccatcaaccgttgcaatgcccttaccaattccaatgttttggtgaactttttctagattgacttctaatcttaacgtatcaccagggcggactactttacgaaattctgctgaccgaatcccaccaaaataggctgttttcccttggaactcttcttgagataagagagcgacggcacctgtttgcgccaatgattcaacaatcaatgctcctggtaaaactggatttttggggaaatggccattaaaaacctcttcattaatcgtgacattacgccgtgcaatggccttcttaccagggattaattcatcaacttggtcaattagtaacattgggtaacgatgaggaaggattttttgaatttcagttatatctaaagttttattagtcattatctttatcctcctgaactgagaaaagtggttgttctacttcaactaattcttcattgcttacacaaattgaagtaacgattccgttaaaagggctttttatctctgtcatcattttcattgcttcaatcacacaaacaacatcccccttttttacatggtcgccacttctaacatagggatctgcatcgggggttggttggagatagacagttccaactaggggcgcagttatattttgcgaaggtaaagttggttgttcgtttgcttttttcttaactgaagtcgtttgctctgttttttcggttgttataagatcttcatgcttgtgagtttgcttatttttgcttaaatagagctgaaaggaatcttgatttatttctaattcacgaatatcagaatcttcaaaatattgcattaatgtttgaatttctttaaattccaagatagatcactcccatttcttaaaggctaaaacagcattatgaccaccgaagccaaaagaattgcttattgcgtaacgggcgtttgatgcgtcactattttctgccgtcacaaggttaactgagcacttcggatcttgattaaaacaacctatattcaacggtaattgtcccttttgtaaagcggctactgttaagaccgcctcaattgctcctgcagctccaagcaaatgtccagtcattccctttgttgaactgacacgaacattgctatcggaaccaaatacctgattgattgctttagattcgccttcatcattagcatgagtagcagttccgtgggcattaatataggaaatttcgctaggattaattacagcttctttaattgccagttccattgctcttgccgctcctgcaccagttggatcaggggatgtaatatggtaagcatctgaggtagcaccatacccgacaatctcgccaagaatgttagcaccgcgtttttgcgcatgctcaagatcctctaaaacaagtgttgcaccgccttcacccaaaacaaatccttggcgtgctttatcaaatggcaaagaggctttaagtggatcagttgcttgtgatagggctgtcaatgccgcaaagccagcaattccgatctcatttaccgaagcctctgatccaccggcaatcattactttagcgcgtccttctttaacttgacgaaaggcctctccaattgcattagctccagtggcacaagcagtcacaatcgatgtacaaatattttgcgcattaaagtgaattgaaatattaccggctgccatgttagcaattgacattggaacaaacattggtgatacccgtctaggacccttatcatgcattttgataatttgctcttgaatagttgtcaaaccaccaattccagatccatagataacgcccatgtcgactggcttggtatttgtttcgttaatctccgccatttccattgcttcaatagcgctttgtaaggcgtattgagaataaagatccattcggcgcgcagcttttctcccgatgacatcattagggtcaaaatcgtcaatttcacctgccacggtaattcctgtcggcttggcatcaaatttcttgatcgctttaattccaactttgcctgcaaaactattacttataaattcttgaataccgttaccattaggagcaacagcacccattcctgttattacaactcttgtcatttagttcctcctaaattgtcatgccaccgtcaactacaatggtttgaccggtcaaataatcattttctgctaaaaattttgcggtcttagcaacttcttttggctgtcctaagcggttaagggggatgcgactgagaatttgttcttttactcgctcagataatttttcagtcatatcactagtaatcattccgggagcaattgcattgcacctaattccgcggtgtgctccttcttgggcaatagatttagtaaggccgattatacctgccttgcttgccgcataattagcttgtcccgtattaccatggagacccacaatactagcaaggttaataatgcaaccggctctttttttgagcatcttcttaaaaataggttgcgttaacataaatgttccgcgtaaattaacattgatgatctgatcaaaatcgctcgttttcatccccatcattaacttatcattcgtaattcccgcgttattgataagaatgtcgatcttctcgtatatttgccacgccgctgctgctaattcactaactgattcttcgtttgcaatatcgcccttaagatagtgatattccgttcctagtagatctagcttttctttaaacgcttttggtaagtcatcttgacgcccattgagaattaaccgactaccagccttagcgaactctaatgcagtagctgccccaattccgcgtgtgcttccgcttataaaaacgactttatctgtcagttccatctttttgctcctttataaaattttcataatcaacaagattttcaatgtgttgggtatttaagtgccggtcaacttggtgagcaaatcgagataacgtctttccaggaccaatttctaatgttgtgtcaattttcgcgtatttgactaattccttaacattagctccaaagtgtgttggaacagctaattgtttttcaagaattcctggaagattctcacaatgaaataagctgttagtagtattgctaataacttcaatctgtggttcatggaagtcgactgtttgtaaccggttatgcatctgttgacgtgcaccgttaaagaagggtgtatgaaatgcaccattaactttgagcagaatcgttcttttagcaagcttgtcttcttccatctttttgagggtagcctttaggtcggttaatgccccgcctactacgatttgtcgtggggaattatagttggcgatataaacccgctgaccattttcttgttgagcggtgattagttcttttatctcttgaagttgagggtcaaggacagctgctaatgtacttatttccctgtccgcgtcttgttgcataaagcgcgcacggtccgcgactagtttgattccttcttcaaacgaaagtgagttgctagcaattaaagcagcatactcgcctaaggataggccgatcatccccttaattggtagttgcggtaaatctcgttttaacattcggtagattccataactaactgttacaattgctggttgaacatatactgttttattcaactcgttatgctcgtttttcataattttgagtaaatcaagctcacaaacatcacttgcccaactaacaatccttgaaaaaagggagtcggccataagctcgactcccattcccgatcgctgtgcaccttgaccgctaaataatattccgtagtacattatttttcatccaattgtttctttacgaaatcaacaacgtcactaatagtctcgattccttcatcggcatctaattcaatctcaaacttatcttcaagttcattcataatttcgaaaacatcaagactgtcagcatcaagatcatctttaattcgtgcgttcattgttacacgatcttcgtcaacatctaattcatcaacagtaatagtttttacagtatcaaaaatttcttctttagtcatattcattcttctttctctattaatagtttaaaattattgttcctgtacttaaaccgccgccaaaaccactcattgcaataatattacctggtttaaccagttcatgagcaacagcttgagtcaataaaattggttcactagcggcgcccgtatttccatattcactaatattcattggaaactttgtaattggttgccctagtctctttgcaatttgattaattatccgttcatttgcctgatgtaataaaaaataatcaatatcatctaattttaaattagcttgttgaacggcagaagcaattgaacgcggtacttcatgagtggcaaaacgatatacatcacggccggccatcgcaaaaggtgaaagggatgttagttgcttagggaagccagctttaggcgttgtttttcccgcaacaattttatctcccaagtcaccaaatgtatggagatcacggccaagaattaaaggagttgccgtagttgtcttttgaagtaacactccgccagccccatcgccgaacaatacggcagtacttcgatctttccaatcaatcagttttgataatacttctgcaccaattaccattgcattttgccaattagagcttttcaacattaattcagctgtattcatggcatagataaaaccagtacaagctgctgaaatatcaaacgcaattgcatttttcgcccctaattctccttgaacaatggcagcagttgacggcgtataggcatcaggagacatcgttgcaataataattaaatcaagttcagttgtcttcaaattggcattagtcaataactggttaccaacattaagagccaagtctgaagtattttcaatattgctgatataacgttgatgaattccagtccgcgttttaatccactcatctgaagtatccataatagttgataattgctggttagtaatattaagtggtggatgataactcgcagtactagtaattcttaaattttgcaatgtttgtcaatccttatctctaggcatgctcatccacaaaatcttctaagttttgcaaggcttttttaacaaccttcatttcttcatcattcattcctttgagaaaacgttcaaccatcatgttatgaaaggcccgatgtgcacgatatagtacccgtcctcttttggttaaacgtaaccgaacaatgcggcgatcatctttatcacgaattctttcaacatatccttttcgaattaaacgatcagccattgaggtcattgttcctggagttagatgaagcttttctgctacttgagaaattgtttgatggttatacatcgtaattgcatcaattgcatgcatctctttaattgttaaatcattgaatgtacttttccgtaactcattttcttcaatccatagaattccggaatagactttgattaatcctttattgattttttcgtaatcattatctttactcataatatatttcttcccttcaattttattctatagccccgaataatttgattatcaaaatatattataaatgataatgattcaccatgctaaatcttttcttctcgttcagcaacgataaagacaagttctgcattacaagctattttgtcgttcacaagcgcttgtgtttccacaattcccattgatgatcgaacttttttcataacaacatttagttttaatacatcaccaggacggaccatttgtcgaaacctcgctttatgaattgcgccaagataagctgttttcttataaaaatgcggtgattttaatatcaaaattgaagcagcttgggccaatgtttcgataattaaaactccaggcataacaggattattaggaaaatgaccgcgaaaaaatgattcattaattgtgacattttttgttgcggtaatcttttcttcaggaactaattcgtctacataatcgatgtagcaaatcggatatcgattaggaattaattccataatctcctgcgcattcattattgccaaaaagattcacctgccttcaaaaaaatatttcgagtatcaaaatattcgatgatcaaattatattcaaaaatattttgaatgtcaaattatttttatgtcatttaattcttaatcaccttaaattaaaatattcctttactatttaattgagaattggtaaaataatatttgctcgttattaacgggaaatagctcagcttggtagagcacctggtttgggaccagggggtcgcaggttcgaatcctgttttcccgatagggtttagagagtcgttgaaagttttctttcaagcggctctttttagtatcaaggaggatataaaaatggaagcagataaatatttaaagctaattcaagaggagcttcagaaccttcctgattatgttaacgagtattatttggggaccaaccatgcagtcacaacaacctatcagtacttaactgaaattcggcgattctttgattggttacggtcaagtggactcgtctctgttaactctaataaggacttgccaattgatacgctggctaatttacggcgtagtgatgtaatgctatatatcgattatttgcagcatactaccaatgcacaaggacggttaaattctcccacttcaattaatcgttctattaacgcattaaggtcattgtataaatttttaacagtcaccgcagataacaataatggcgagtcttattttgaccgtaatgtaatgttgaaaattgactcccttaatgatacaaaaacattaaattatcgggcgcatacgctggcttcacacatgtaccggggacaaatgaaatttgattttatcactttcattgaagaggaataccctaataaatgtgataaaagagccctcccctcttataaagtcaataaggaacgagatattgcaattattgctcttattttaggaacaggcgtccgggtatccgaggcagctaatgtaaaccttggggatttgaacttaaagcaatcactgctagatgtaacaagaaaaggcggccagagagattcagtaccaattgcaccttgggctattacttatatcaaagcttatcaagcgattcgtgcacagcgataccacgctttaaaaaaggatactgctttcttcttaaccgtttatcacaagcaaactcgacggatgacagctaatgccattgaaaaaatggtcaaaaagtattcaactgcatttggacatcctcttactccccataaattacgccatacccttgcttctgaaatgtatgaggtaacgaaagatcaggtattagtagcccaacagttaggacaaaaaggaacatctgctactgatctatatacccacgttgaccagaaacagcaacgtgatgctcttaaagaaattagtgaaacttcatataaaaaaacaaatgaataaaaggcttttctataaagataatcttcgctataatgttaagcggtgtataaattttttatggaggagaaaattttgggctttattacctcattatttggaaagaagcaatatatttgtccattttgtcatgagcactatactttttctgcgatgcatgcacgcaagctagccgacaaagatgggcaaattcattgttactactgtcgtaaggtcttacaacaattgcattagtattaatgataattcgcttttttacaataaaaactttcaaaataaaaaaccgttaagctgtgacgtgtacccttaaagttggaacctgtatgttcttgctttaaaattgaataaatatttttctaggcaactagattctgctcatattgaagtggagtttggttgcctagttttgtctgaatacggcgttcgctataaaagtgaatccattcattaaatgcttggcttaattcttcttgattgcgataactggtatcaggaccaatttctgctttcagtttactaaagactgtttcacaggcagcgttatccagacaggttgctcgatgcgacatgctttgcctaatgtttccctgacgaagtagtttgcgccaagcacgatgttgatagtgccagccttgatcagtatgtaaagttaattggtatcctgtatgaggtaactgcttaagtaattgctggagtggatctaatgcgaattgaagatttggatgttgactgactgaccaagtgagaagctggttagttgccaagtccttaataatttctaagtacacttttcgcccatcatgagcctttaattctgtaatgtcacaaaccattttctgatatttacggttactcataaaacgccgatttagcttattcttagctttcttgccatttggtcccttagaggaatcatacttacggactcgccgattatatttgatacatttaagtcccatttcatgcattaagcgctgaatgcgcttatgattaggtgtctttttaccaattaagcgatagtagtctcgaatttgagtgcttaaacggcgtacgccgtttaagcttggaagtagttaaagaggcctttaataacggctttaagttcttcttcatcctcgtccggatgttcaaaccgattttgccaatactgataggttgacatggaaatgggaagtgcatcgatcaaatcctttaataagtatttagccttgaggtcataaattacttgtgcgagttcttttttggatgctttctcaaggctgtcaatttttttgaggcatcgagttgtatccttaacaataagttttctctttgtaaggtttggttctgtttttggagctgaagaagcttgtcttgattcttgtcgtgtcgtttgaccatttttaggtttccttccccgacgcaatctcagtaaagcctgtggcccttgcttgttatagagacattcccactgatacactgaacctggagaacgatatccaaagtgaatacaagtttctgagattgacgccaaattttcttgtttccactttaccagatttaaccgaaaatccccagttactttgggtggattgagtaatggtcctttaccaaatcttgcataaattcccacccaaatttggaaatcatgctcagcaatcccgtatttatgcctaactgatgctaaagtaacattaccgttagcatattcttcaacagctttaagtttagttttaacgctaattttggtcatataaaatacccccagagttgatttccaactctgggggtacacgtcactgaatttaaggcttagcggttttattttaaagtatttagttaaatcgacgtttgttaattcctgcaagaccaaacatactaagcaatgtttattcccctctgagacgaattgtaacgacctactactcatcaaaatgaatttcagttcgtctgagaggcaaaagttgtttttacccctacttttgcattattttaaaattagtaagactcttttgataaaagagtcttacattaaccgagaataaacgttgatataacaagcttttaaaatcctatattttcgtgtaagactgttgtataattttattaaaaaagtgtctcactaaaaattaggtcatttttgctatttttggcggacaaaaaggagttatttcattttatgttatataatgcagcattagttttagaaggtggcgcattccgtggccaatacactgccggaattgttgatacatttctcgctcaccatattgaatttcgaagtgtaatgggcgtttctgcgggttcgctttgtggagttaatttcgtctctaagcaatatggacgcgctgccaatattaatattaatcatcggcacgatcgtcaatatatctcgatggctcgcgtatttaaaaagcaaataatcaatcttgattatctttttgaggatcacggatattcttggcagaattttaacgaggcagcttatcggcgttcagcatctcatttcacagcagtcgctacttctgtgaaaacaggaaaaacagttttgtttacggatcctgttggtgaggaactaaccaatgccctcaaagcttcttcttcgatgccctttctttcagatccacaggaaacatcccaagggccttgccttgatggcgggattacagattctattccatttgatattgcccaacaacaaggatatgacaaaattgttgttgtccggaccagagatgttaattaccggaagaagccatccagttctgctgtaaagaagttatataacatggtatataaagattatcctgaatttgctaaagcagggatcgatcgtccccttctctacaaccaacagattgctgaaatcaatcgcctagctcgtgaaggaaggatctttaatatcgctccctctaaaccaatcaagattaaacggattgaaggaaatattaagaagattcgagcactttacgaaactggtcggaaagaaggagaaaaaatagttcctactttagttgattacctcacaaactaataaaggaagaaatattatgtcaactaaaaaacgcgtttatattcctaaaaataagacgaatggtcaaatcaagggtaaacggaaaatatgggtagaaaatgttaaatttttgactctcgaagaatatgatcagttacgtgagacaattaaattgcattctcgtcctgaattagttaatcgtaacctattactaattgcgattgcccttaataacggattgcgagcatcagacgttgtgacattaagggttggtcatgttctaaacaaaactaaaacccgtgttattgaacaaaaaactggtaaagctaaaaccctcttttggaataattgccttgccgagattattgattatcttaatgacttggattacaaagatgaaaatgattacctttttcccggaaaacaagaaggccatttttcggtgcatggcttttacgagatgttgcaacgaatggctagaaaaacggaaaataataaaatcgttgctaagattggaacacactcttttagaaaaacttttggtcgccaactctataagaagggggttaacgttgaaatcatttcgcagttgtttaatcactcctccgaacggaatacgcgccactatctagggattgaacaagaagaccttgataaagtggttcaaaatttcaaatttgaatagttattattctgaatattatgtaaactaaaatatttagtcattttcctaatagacttaggaatataattcattagaattaaagtaataaaaagtattggatgtgactaaatgaatataaaaagtgttccaaagaagcaactatggggaattgaattaaatctggtttctctcctatttagtagtattagtccggttcttaataaattttcacttactagcttgagtccggttgttgggggaattttcactagtgcgtttgctgcaatttttacttttgcaacaatcctcattactcgtcagcatgtttctttaaccaatcttaagagcctgtggttatggcttttgggtggaacaaatgcaatcggaattattcttcaatatattgctctctcaaccttaagtccaatcacagttactcttatcgctcggatgtatttagtttatgttttcttcctatcttatatcttcttaaaggaaaagattacaaagtgggattacttagcaattattctttgcattctcggttctttctttatttcaggaagccgtcttcaatttagtgataaccttcttggattgatttgtgcattcatctacccactaatgtatgccgccaacaatatcgtggctaagtatctagttagtgatgaagagccaaataatgtcttattctttaaccattttacttcggctcttttacttttctgctatgctctcataacaggaacgtcatttagccatatttctagtcaagcagttgcatttaactttggtggagcattctttaatggcttcatgtcactacttcttttctatactagcttacagtttattacagctggtaaagcaaatattgttcgtgcacttggtccagtaattgttattatttactcttcatttttctttcctgttcaggtaactccttccctagttttaggagctattttagtaattttagctagtacaattgttacctttacaagaacaaatcgcgaataatcgtaatataaaagcatcagaatttgggtatacactttcgaggctgggaaaaaactcctagtccaaaataaaaaccggatgatgaattttttgaacaattcatcatccggtttttatgtacacaggaaatcgttcctgatatgatgtaattacccctaaaaacaaccaaagggagcgatttccatgtatcaaaattataccatagggcaaaccgaattcgtactaaactataactatgatttaccacagaatcatgttgcgcgactaattagtgattttgtcgactcgattccacaagatgtgctattagaagattcaggagcggctaccggccgccctttatcgcatccagcaattatgcttaagattctcttgtttgcctactcacgtcaaacttattctggaagaaagattgaaatgatgttggatgagaacctgccaatgcgttggttagcccatgattatacttatagctaccataccatcaataactttcgccgcagtcagcacgctagtaagctaattaaacatgcctttgtctactttaccatgactttgaaagatcacggactaattcaaaatgatgcagtttttatcgatgggaccaaggtagaagccgatgccaataaatattcatttacttggcggcgggcagttgaaaagtatcacgctaagttaagagaaaagacaagtaagctttatgaggaactagtagaaaagcaagtggtacaggaaatggcaccggagctggttacttccgccgaaggcatggaagtaatggaacaagaactggcggagaaaatcactaaattagatgaaaagattaagcaagaaccaaaaatcatcaaagggggttcagttagaaaacggcgccgtcgttttctaaaaaagcttcgtcaccaattaagcaacgacctaattccgcgtgcccaaaagtatgaacgtgctgaaaatatcttccaaggtcgtaatagctattccaaaactgaccacgatgcgacctttatgtgtatgaaggaagatccgatgatgaatcgggagttgaagcctggctataacctgcaaatcgctacccataagcaatttgtgcttgattacgggctgttttcaaatccaactgacaccaggaccttagtgccattccttacccagtttcatgctttagatttctttgaacatatcgtcgccgatgcaggctatggaagtgagtacaattacacaatgattcttgatcggtttgaaaagcagccggttatcccatacacaacctatcaaaaggaacagaaacgtaaatttaaaaacgatccaactaggtcacagaattgggaatataacgctaatgacgactactacattgatcatcaaggagttcgttttagtttttatcgctatagtaaatccactgataagtatggctttaagcgtgactttaaaatctatcgtgctgataaacatcaactatcagttaaattagatgaactagcgaagacaccaggtggtcgtcaacgttatatgaaggttaacccaacctggaattattataaagctaaagttaaagatgccctctcaagtgacgaaggcaaggcaatttatcgtcgacggaagttcgacgttgagccagtctttggtcacatgaagagggattttggcatacgccgaactcatctccgtggccaacgggctgtggaaaatgacattgggctagccctgatggcattaaatctaacgaaatttggccaatcaattagtcgattggagactaatttcataaataatttaaaatccggactatgatttttgaaccgatcaaaaatcatagtccggattttactgtttgagaaccaaaaattaatagttaattcccggcctcgatttttttgtataaaaaaagagacatttgctgtcccctcgttatacaatcaattcaccacaaaaatcatgaaagaaggttaaacaaatgtcccataatgattctatcctaaatattcttggaattaaagataaaaatattaaaattatttctgttgaagaagctgaacacaacgatgactctgttaaagagtatataacactaataacggctactctttcttatccgattaatcgttgtcgtaactgtggctttcccacagttaataaggatggctttcgcaaaactcatgtacgactggctagtttaaacgggagaagatatgaactagagcttcgtaaacaacgctataaatgtaaatcgtgccatactacgtttggtgctattactaatttaaccaaagaaaatcaaaccctatccagtaatctcaaaaatcaaatcatgcttttagctcgtaaaggactatctggtcagctaattgctgaaatgtgtcactgctctcctagcagtgttcgtcgaacaattttagagcgcatggaaccacactatcgtgtagctaagttgcctaagcatctatgttttgacgagtttcgttcaactaagtctgtgatgtcctttatctgttgtgacgctgaaacccaccaaattgtcacaaagttacaggatcgtctatcacctaccattattgattattttgaaagtcgttattcaaaagccgaacgcgaatgcgtccaatcagttgtgattgatttaaatgctcaatatcaaagctttatctatcgccttttccctaatgccagcattattattgatcgtttccatcttgtgcaattagctggtcgcgctttggacaattgtcgtatttctatcctaaaacaacttgataaacagagccgagaatataaaattatgaagtcacattggaagctattccataaaaagctgaagatcttcaccctgaagaagtagtttttcttcgcggcgttaagcaatatatgactcgccaaaatgctgttgatctcattactagtaaattttccaagtttgctgaagtataccaaacttaccaagatatcacgaaagccctaaacgagcgcaatagtgaattactagagtcaaccatcttagactaccaaaaaaccaatacagaaatggataccgctatccaaacccttcgtcaaaacagaaaatatgtcttaaatagtgctaagtttgaatactctaatggtcctttagaaggcatcaattgcaaaatcaaaactctaaaacgaacttgttatggttttgccaatcaaaaatttttctttttaagaatcgattgtattttttcgtaaaaaaataccccctacattttcgtaggaagtatttttagtcaaccataccagttgacagatatcccagaatttccctgtaaagaaatctgatgcttttattatatcttcttatatactaataaacccttgcacggcgccgatagacaataaaacgacggaaaatatattgccaaggtagcgttaaagcatgaaccaaccgggtgtatgggaagtaaccaaaaattgctaatccacagagaacgtgaattttataaattaatggcactgaacgcatcaattgccattgaggattaagaacaaataggcttcttgcccatggactaattgttgttcgatagttgtaatcgataaatgcacccgtaatagtacatgctagacctagtgcaattgtaatcagtaaagcccagtcgacaataatatcattgatatcacttgtcttataaacacgagaacaagtcattcgtcgataagtcagaattgcaattcccacaaacgcaaggatccctgctggaattcccatcatcaatgacccaaagatgtggtacatatgttcagtgatcccaaaataagctgtccaacttgctggaataaacattcctaagcaatgaccaaagaaagctaaaataattccaatgtggaaagtaacgcttccgatcattagccatttcttttcaaaaagttcgcttgatttggcagtaattgaaggatgaaaatatttaaatctaacaaatgttccaatgaaaaatgatgccaacattatatatggataaataacccataagaaaattgaccagccattatgcatcttctcgcacctccattttaatacacgaaccaattaatgaacgtgtaagcctgattaactgaatatagggattatcactatctgtcactgcattttttaaaagggtataagttccatcttcaatcacacttaatgctaattggatatcctgacgacgcggatcattagtataatcgccatatgctagaaattctaacaatagaggcaaataatcagaaagttcactggtcgcttctgatataccaaacatctcatatagcattttcaaccgtgctaaaatggtccctcgttcacgggaatcggtcatcttatagtatgacatataaagagtataacgtcggttcatttcaaaaaggtgagcgtacatctcttgaacttcgattgaagatagtgcggctaattcatcaaaaaggcttaataattctccccgtgttgctgttgataatgcgttatctgcaagtaataattgacgaatctctggtgaaaacgtttctgtatcaggatagtcaatcaagcgagaaagaacggcaaatgtatcctttaaatctgtcaatcgtctaaaatcaatcacgccaaatccctccatagaaactatcagcataaatctgattagttgatttgccagcttctgccttcttaaacatactcttgtgttggggagctaatgcacagccttcacattcatcatagccaagactaccttgttcggtttgtgcatcttccatttctgccttttggctacttggaataacaaaacggtcttcatatttagcaattgccagtaaacgataaagtgatgttgcccgttcttctgttaaatcaactcgttccagtttactgctatcaaaatcccgaccactagtcttagcacgcatgtatagccgcatcattgcaagtttatataaggctttcttgatgacaggaacgtttccagcagttaatagacttgccaagtattgaacaggcacccgcatttgatcaattcctgggaagatcatttcaggattctttattgagtcccgtccttcaaagtaactcataactggtgatagcggcggaatataccaaaccattggcattgtccggtattctggatgaagtgggaaggcaatcttttcttttactgccattttatagatcggtgacttttgtgcagcttcaatcatctcttcagaaatgccatccttgagtgcttgcttgacaacttcaggatcgttgggatcgaggaataagccaagttgtgcttcatacagcttactctcatcagaagttgatgctgcctcttctactcgatcagcatcgtatagaatagcaccaatatatcgaattcgaccgacacaggtttcggcgcaaactgttggttgaccttcttcaattcgcggataacaaaaagtacatttttcagccttatgagtcttccagttaaagtagaccttcttatatggacatccagtcatgcaaaaacgccatccccggcagcgttcttggtctactaaaacaatcccatcttcatctcgtttgtacattgcgcctgatggacaagaggctacacaaggtgcattcaaacagtgctcacataatcggggaagatacatcataaatgcctgctcaaagttatttttgatatccccttcaattttttgcatgttaggatcctgttggacatattcagttgatcccgctaagtcatcatcccagttaggaccagtggttaattccattccttcgccagtaatttgcgacttaggacgagcaacaggttgatgcttttgttcagggccaaataacgtcttataatcataggtccatggttcgtagtagttatctaactctggcatatcattattgtaaaaaatcttgccaagagcgattttatttaatttgcttccagcacgtaattttaatttaccttttgaattaagggtccaccctccatggtattgatcttcatcttcccagcgttttggataaccgacacctggcttagtttcaacattattaaaccacatgtattcagcgcctggacgatttgtccatgtattcttacaagttactgaacaggtatgacaaccaatacacttatcgaggtttaagaccatgctgatttgtgctttaatcttcactccagttcaccttcttcagttttcttacatttgcataaagatcacgttggtttccagttggtccataataattccaaccgtaactcaattggccatatcctccaaccatgtgtgttggcttaacatggatttgcgttggtgcattatgtgatcccccacgattaccggtaatggtggaaagaggttcataaatttcattatcttgggcgtggtacatgtacattgacccctcaggcatccgaacagaaacaaccgcccgcgcagtaacaaccccattacggttataaacttcgatccagtcgttatcttttaccttaatcttatcggcatcttggggactaatccaaatagttggaccaccccggaataatgtcaacatttcaaggttatcgtagtacatcgtatgaatattccatttaccatgaggagtcatatatttaagtgtaacttcatcttttactggtggaacatcaacatctcctggggccattacaactggtggtaaggatggtttataagttgccatattttcaccaaattcacggaaaatttcatgatcaatgtagaaatgctgacgacctgtaagagtaaatgtaggaatatttcgctcagtcattaatgagaatggtgtgtatcgagccccaccatgtttagcagaagttccgattggtgttggataggcttcttgtggttgagcagtgatttgcttaaatgacattgaatcatcagcatgaccacggccaatatctgttaaatgttcaccagttcgctcttgcttcttttcccaggctcggtcagcgagtttaccattggaagcagttgacatccgtaagattgcatcacatactttttcatcttcatcaagtaacggacagcctgcaccaatgccttcgctggcagttccattcattccttttaaataatcatattgatcatcgactttatagccatagttattcactatattaggtccaagggtaatgaatttatcgtaaatcttggtgtaatcacgagtaaccaatttcaaggaaggcattgtttttcctggaattggttcagtttcaccattcttccaatctttaattttcccgtacggttgagcaatttctccctgggtattatggccaagtggtgcactcttaagatcgtaaactgttcctgacatgtatttctttgccatttcagaaacagtttttgctaagagcttgaattgttgccagtcagactttgattcccacatcggactgactgctgcattaaatggatgaataaatgggtgcatatcagttgatgaaaggtccttcttttcataccaagtagcagctggcaagacaacatcagagtacataggtgttgaaaccatgcggaagtccatatcaacaacaagatctaacttaccaattgctcccttgtcacgccaaaccatatcttggggcttaactcgatcatttggcttagcaagcaatccgttttcagcacctaataagtgtttcataaagtattcagcacctttgccagaagatgcaaataagtttgaacgccataggaagaaggctttgggttgattttggttagcatcaggatcttcagcagcaaaatgcaaagtccctttcttcaattcatcgacaactttctttgaaatttcatcaatatcagttgtattgtaatcttttgcaaaagatagcggattacgatcaaattgtgggtatgatggtaaccatcctaaacgaattgccatttggttataatcagcattatgtaagtaagagtgtttactcttccaaacgggtgacttttgagcttgattatcaatttcttcataacgccattgatcagttgcaaagtaataccaagtagtaccttgcatttgacgggcaccacctttttcccagtcattggcaaaagtaatgtttgcccaaccttcttgtggacggagcttttcttgaccaacgtagtgagcccaaccaccgccagtcataccaacacaaccgcacaacatcagcatattaataatgtttcgatagttcatatcggcattgaaccagtggttgactccaccacccatgattaccatacttcgaccttcattttcggccgcgttttgggcaaattcacgagcaatttgaataacttgctctgcttttactcccgtacggctttcttgccaagcaggagtaaagtaactctcagcatccattgcatctttagcagcaagttcatcattaccagtccgattaattcccatttgagccatcattaagtcgtaaacattagtaaccaagtgttcttgaccatctgtgaatttgagctttttaactggtaaatgccgttgaacaacgctgtttccgtcattactaaatgcagggaaatcagcaataatttgttcagtttcttcaccttgatcattaatagaaagtgccgggtcaatcttattgccattttggtctaataattcaagattccatttttctttagcattatattcctgacccatcgttccatttggaacaacaattttgtggttattttggtcataaaccactgtcttccatgctggattaacaatcgtatcatcatcaactaagtcactaatccgaacaaaacgacctggtgtatagtgagcatcatttgctgtacttggttccaattcaaccatgaatggtaaatcagtaaatcgcttagaataatcaatgaaacgtttgactgggtgcttttggtagaattcatctaaaattacataagtcattgcttgagcaacagcagaatcactacctggttctggtgcaagccagtcatcagcgaattttacattttcagcataatcagggctaactgctacaatctttgttcctttgtacctaacttctgtcatgaagtgtgcatctggtgtccgagttaatggaacgtttgatccccacataataatataggaactgttataccattctgcagattctggaacatcagtttgttcaccccaaacttggggagatgcaggcggtagatcagcataccaatcgtagaaactcatttgttccccacccattaaggcgatgaatcgggctccggcactgaaactcatcattgacattgcaggaattggggtaaaaccaccaatacggtcgggcccatatttcttaattgtgtataagcaagcagctgaaatcatttctaatgcttcataacgatgaacacgaattaagccaccgtgtcctcggacctttttatactttttagacttttctggatcttcgacaatacttgcccacgcatctaagggattttcatgttctttcttggcagcagtccaaagctcccataatttaccacgaatatatgggtacttaattcgaacgggactatattcataccaagagaaactagctccccgtggacatccccgtggttcatatcctggaatattaggtccgcatgatggataatctgtagcttgatgttcccaagtaataattccttgcttgacataaacattccaagaacatgagcctgtacaattgactccatgagttgttcggacaactttgtcatgcgcccatcgctgacgataaagcttttcccaacgacgactattttcttcaagttgtgtaaaggttccattaaacttatcaaccttgttaaagaaccgtgacttcatcgttgattgacctcctttattgaatggcttaccaatattaaaaataaagtaagtcttttccctaatgtaaagattagcaccataactgctatactacgactagggaaatacctatattttcgaactaaatgaggtgttaatatccatgaatcgttacgatcgtcaagaaagggtacatcaaattggtgtcgttggtcagcaaaaaattagccatgcaactattatgattgtcggtgtaggagcattgggaagttatacagctgagcaacttgtccgtgctggagttaaaagacttgtcttaattgatcctgacactgttgatgtaactaatcttcaacgtcaatcgcttttcaccgaagcagatgctaaccaacaacggcttaaggtcgaagcagctaaagaacatttacataaaattaattcagcatgtcaaattattgcgatcccagcgccaattactgctgatcttattgacgaatatcagtttaccctttgtttagactgtcttgataattatcaagcacgcgatctattaaacaaattggcaatcatcaaaaattttgattatctgtttgccagctgtgcaggaacctatgggaacgtaatggcgatttcgccacaaaattatccttgcttgaactgtctttttcctaatatcaatgaattaaaacaaaacgattgtgatttaattggggttaatactgctttaattcctattgtagcgggactacaggtatctttagcgcttcattatctagttgataaaacacaggttaattttaatgaattgatcactgttgacaattggtcaatgcaatttagtaaatttatcattaataaaaatagccattgtccggcttgcactaatcctagcagcatttctttggaagaagaatcagcaccagaattacatatgttatgtggggaaaatgcatattatacagtcaaagagaaacctattaattttggcagacttaaagaatttttggctaaaaaagagctcttaattaacgcaaatcgattgtttcttcattttaaatgggaaaatcgtccagtaagtatattcaagaatggtaagattgttatgtatgacttacctacttcggcgattgcccagaaacagtttgagtcattaaatactttaatgaaagaagacctattatgaaaaaaatcgcaattttaacggttagcgatagtcgaacattagatagcgatacttctggaaaattaattgctatgaagatggctaatgcgggcctatcagtagttgatcgggtaatcgttaatgatgatattgtcaatattcaaactgcctaccttcaactagaacaacaagccattgatatcatcattactaatggtggaacaggagttgctcagcgtgatgttactattccggctatccgtccactcctcaaacgcctaattcctggttttggggaagcgtttcgccagatatcttttgatgaaattggtactcgggcccttgcatcacaagccctagccggatttaattaccgcaaccagctcacctattgtttaccaggttcccagaatgcctgtcaaacggctctaaacaaactaattttgccagaatatgaacatttattatttgaaagcagttcccaacgaaaggaagttcaccaccatgctcactagaagaacaccaatctctgttgccgaggcacagaaaaagattaacgaaatccccctgaaaacaactacagaaacaattcccctatcagaagctaaccatcgtattttagctgaggatgtccatgctcattatgactatcctcattttcgccgagcaggaatggatgggtatgcaattttagccagcgatgatcatgacttcccccgcgagtttaatgtccgaggagagattcaagctggagcaacttgggatcaaccattacagccaggggatgcagttcggataatgactggtgcatatgtcccttctgatgcggggaaagtaattcgaattgaaaaaactcgtcctgctgaagataaaaataaggttcaaattattacaactgagagtaaaactaacattacagaaactggtactgatgtaaaaagcggtgatatcgttttagcaaaagatcaggaaataaatcccggtggcctagcagtcttaacggcttttggtgttcaagaagtaacagtttataaaaaaccacggattgcaattatcgccactggaactgaattattaggccctaatgagacaattgaaccgggaaagatctttaatagtaatggaattatgttaaaaaatctggtagaagaaactggtgggattgttgattttgaaacccaattaccagatgatgctaatcttatcaagcagactcttgaagaacaaatagcaactcatgaaattgtaattactgatggtggcgtttctgtcggtgattttgatttcattggagatgaagcacgtaaagctgatgaattgctgtttaataagattaagcaacgaccaggaagcgttacgactgcctttgttcaaaataatacgttagtaatggctctttctggaaatccaggcgcttgttttactggcttttatctctacatggaaccgctgattcgacgttatcaacaccaagcaagccgaattaagcgagtacgggcaatattagcagccccatataataaaactaacggctttgatcgttaccttcgttgtacttatgaattcaaagatgatcaattttatgtttatccaaatggaatcaaccgatctggctcattagctaacctccagacgacgacctgtttggcactgattccgcatagtacaactccaatgaaggttggaacggagactgacgcatggctattacccttcaaataattggtcataagaaaagcgggaagactcttatcacgacggctttaattgaaaggctttcaaaagaaggatatcgagtagctgctcttaaacatgatgcccataatgctgcaatggatgtgccaactactgacagtgctagaatgagtaacgctggagcaaaccaagttatcttgcaatctccaactgaatttttctttcatcaaaaaagtaatgttccaactttaacggaaatggttgagttgttaagtgacgacaatgattttgtcttgattgaaggccataaggaagccactcaatatccgcaaattttattattaaagcctggcgaagatcctactaatattgctcctactacgccgcttaaaaccggtagtatttttagtgggacaaatgctgacttactagggaaaaatacaattgtaaactggtgctataactacttaaaacaaataaaggagaatacttgatgattggattagtatacgcgggcggcaaatctattcgctttggtaaagacaaggccacttatcatgttccaagattaccagctaccaatgtacagctagcagttgagaaactaatgcccctttgtcagcagatcattgtttgtgctaatgaaacaaatcgtgcacatataatagaattagttggtcaggtaccggctgtgcagattatctgtgatattcctccttatgatcatcatggtcccctttcagcaattattgcttgtactagtcaattttctgttgttcaagactatttaactttggctgttgattatccatatatcacaaaagatgtacttgccattcttgctcgtacatccaactcttatattgtaacaagtcagcatagtcattattcattagctcatttttcaattagcaatgaacaagttactacatgggttgataataatagtgactggcgattacgtagtttcatcactaataaatgcgggtgtcatccccttgcatatcgctcaagtgccgaattttcaaatttaaactatcgtgaggtcgatttaaatgaaaagtaaagattcaatgacaaatcctgattttcaaaaactcatttcccttgtcttaaatgacttaacaatcagacgaacaatgttagaaaatcgggaacaagaagtaaaccaacaaatgagttcactggaaaaagatgctaaattggagcaattggatgaccaaattcaacaaattcaagctgattttgatcattaccgtgaattccaagatccggaatttgattttagtgcaaccaagtatttccagggaccatcgatggggttaccacgacatccttaaaagctagatggcagggctaaagaagcagagcttttcttagccctgccttttaagttgtctatcgttgcttctagccaaagaaagcgttaatatataaaataggaatattatgatagcaattggggaattttattggggaggaagcagatcgtgcttgaaacagctaattggatacaaaaatattttaatcaatcaccagatgcaatcttcttatttaaaaatgatgatcttttagttaataatgagccggcacaacggttagttactatgcttaatttagatgtcaattacctattacaaattggaaagaacgcttggtcacaactggaaaatgatgactgtgcgtcatgtctgattaaaaagcggttaaaaggagctgcagttccgataacatttcattccaatgctactcatccttttcacttttcaatggtttatcgtcctcttgatgataaagaaaatgtctttgccctaactcttgaaaatagtgagcaacagcagcgcctttctcaagttgaggagcaacgaattctcaatcaatatgtcaatgaagcgcatgaaaaggaacggcaaaaaatctcacaagatcttcacgatagtgttgcgcagggaatctacgcggcaataatgggcattcaaagattagcaacggttcaaaatccaagaaacactgagcagtttcaatcaatgagtgctgcaatcgaaaagcagttacaaacgacccttaaagagattaaagagctcgcactcgatatccgcccctcggtgctcgataattttggcttaattccagcaatcaaagctttggcaaaacggcttcaaaatagtacaggaatcacgattaatgttatagcccttacctctgccgaaaaactgcaaaaaaatatccaaaacgttctttaccgaattacacaagaggcaattaataacgcaattaagcatgctcattcaacagaaataactattattgttaccaaccataatagttaccttcagttagagatccttgataatggtatcggctttgatcttgaacagcatagcagatttaatgggcattcacttggattaatgaatatgaatgaacgcgttaaggcatataatggggcctttacaattacatcaaaaattaataagggaacgacagtcaaggtgaagtttccctataataatttaaataaggatacggtgagaacaaatgtataacgttttagttgcagacgaccacgcaatcgttcgttcaggaatttcatatttagtcgatcttcaaccgaattttacggtggttgatgggacagcgagtggaacagatacatatattcgagttgaacaaggtggaattgacattttaattatggatttaagtatgccccctggcgaaaatggtctgattacgactcggcgaatccatgacaagtttccaaaagttaaaattatcattctctcgatgcacgaagaacaggagtatatcaataaggcaatggcaaatggcgcaatgtcttatattttgaagagttcaccggatagcgaaattgttaacggccttaaacatgttataaatggtgaaaaataccttgatgcaaacatcattgttagtaagaaagacattaaggaaataaatgcttctggtaatatcttaaagttaaagggctataatggtctctctaaaagagaaaaagaagtctttccacttattgctttagggtattcaaataaagaaatctcccaaaagatgtttatttcaacaaagacagtagaagcacataaagcaaatatttcacgcaaacttcatttacatggacgggttgaactagtacaatatgctattcatcaccatttaattgacctttaactagcggggattctgaattaagaagaatccccgattttatttacttcgatatttttttacaataaaagaaatacgattaaaggagtggatttataatggcgacgaacctcagtcaagaggatgagttacggggaatcctcagtgatgttgctcgcaaacgctttactaatagtcgacaagttaatcccgtttccaacctgtttttaacaactaaatatgcagttgaaaaccaatatatttctggagcagttattgacgaatcatttagttcaacattagcagagataaatttaaaaaatgctgttttaactgatcgcggtcgtaataagcttgcacaacttctcacccaatcagcaaaggagaattaattaagatggatattcaagataagctaaaacgagattacgaaaataaatcgatctatactgcaggcttttacgcagacccagataatgaccttgcaaatcgtaaaaaattatttgatgtcttaaaatcgctagttgagaatcaagaagccacaacgccatttgctttacaaatcatgcttacaaatggcgaaattaatgtaatgcccctcggcctcgttgatcttgatgaacttaaaaaatatgaaaatgaacaacgatccaagcatggtttagatgaatataacgatgatattcctcttctaatccaatatgcccctcatgcagagaaaaaagaagtggttaaaaaaagaataggtacagttcaagatctttttacaaactttaacgagcaaattgaaaaaatatggcaaactattaagaaatttatgcaggataattttgctttattaacgactatcgaaaaggatttgattgctgatagtcaaaatgtgatgcaagaatatcggattactttttccaagatgactgaggctgaacgaaaagaaaagctggggtttagtgttccggaaaatgaaatcaaccaattttgccgttacatggctgatatgcatgaagtacaagcagtcgtattatctgctggtgctttcgttaaccatgaacttcttggtaaaaattcctttactgagatgataagcgataacattcgacggagcaccctcttctgggttcttgataataccttctacgaaatttactactacttctacatgagcaatgccaatgataagcttcataaaagacttaaacatcaacgagaaacctttatcgttaatatgcgtaatgatgcttttcaccgtgcacaagaatttactgaaaagcaaacaaaaaaggttgattttaatgaatacttcagtgatatcttcatccccgttgctgaacaaataattgctgaagtaaataaatttaaggactgatactgtgaatttaacaccagatgaacggctggcagatgcattaacaaccattatttatcaatatcctccaatggttcgtgaaatgattaatcttaatgccggtgaaaaagaacgtctgctaagattatcgatttttgaagctttcagtcacctcagcgaaagagatcttacgattgatcaaatcacagctgctcaattaccggaactattggcattagcaactcatttgaatcctccttcttttcaaccaaataacctaactcctggggaattcgctagtcaaaaggcatattcatatgttgcgagctatttgatgaatcgctttgtccattcgttaagtactgtaggtaatcccccacaggtacttgaagagttgataactgacgctggggatgtgatgcttgcacaggttcgacgactgcagtttaactataatcagcaatttaaggtagctgattatttagcagatgttaaagcacggtggggattacttggagcaatgaccgcaaaacaaagtgccgtccttagtggagcaggaaatgaaattgtctcgcttgcaggacagattggtcaagcctttggtactgctagttatattacacatgagtttcaacagcttagcaatgatcccaacttgtttataaagatgataacggctgggcagtatccactggcacttttattcgctcgtcaacaagatccacaatggtttaataattttttctcttcaaatcatcgtccttcacaagagatatttaaccaagcttataacttagtgcttagccgcactgatgatgtcaaacagctgatcaccgatatcttctcccagttaatccttgatattgaagtattaccgactggtcaaactcaggatgaattgcttaaactagttgaagaattaaaaaaataatttaaaactaaaaatggagattaaggaagaaattatcctcatctccattttttaatgtgcttatttaacgatatgaacgtcaccatgaatataatgtttccatagagcaaaccagcaaattgcactggttagcgctaaaagcgcaattccaagctcataactacctgtccattggtaaatataaccaataattagtggtgggaagaatcccccaaggccaccaacagctccaacaaaaccagtaactgctcctgtattaccttgggatacatacggaaccattttaaagacaaccccgttacctattccggcagaaagaccaaccaaaacaattcctgcgataaacatgaattgattgtggaaactaagcataatccaaatagcaaagataacgattgctacaaagacccattgtaataatgccatcggtcgtttcctatcggcaaggtaaccaccaaatggccgaactaacgtacatacaaaggcaaataaggccgaataaagacctgctgtaacaggagtataatggaacatcccagttaagaatgtcggcgttaaatttgtaaaggcaacgaataaaccgaatgtaaggaaatagaacagtgataggtaccatgttccactgtctgtggcaacagataatgctccctttatcgtcttgcttttatcaactggcatttccttacaaaaaactgcaaagagaacaccaaagatcactgtaagaataatcaagaagtaataaacactatcaaatcccgccgccttagaaatatacggtaaagtcattgcagctacagcattccccatgtttcccattgagacaatcccaagagctagtccctgctgttctggcgggaaccaaactgaagcataagaaactccaacagcaaatgatgttcctgacatcccaacgagcaatgcagcaaagagcaacatcccgaatgaatggacatgtggaatcataattagtggaatcaaaataaaagccatcaaaatcaaatagacctttttcccaccataacgatcacttaagatccccactggaattcgcataattgaccccaaaaggacaggcgttgctaataataacgttcgctgcgatacatccaaattgaacatctcagcgacctgggatgcaagtggagcaaagttagaccacgacataaaacaaacaatcattgcaagcgtggagaggattaatgcagtataagcatttcgcctactcccatgagcaacatctttaacacttgacataatcaagtcctcctcctatttaattctaactatcttctagaatgatctagccaccactaaccggcggaatgattgcgatttcagtatcggcctctaagttaattgtatcagcgttaacaaattcttgattaatggctactcgcgaatttgctaaagttgacgtcagttgtggtgcacgctggctaatttgcttaagaagggcgtctactcgaataggattagtaacatcaagagttatagatggccctaactgatcttgtaaaaacgcaaataatttaacgttaatttccattagtttccccaccttaccttatctgtatcatattcctttttccagattggtacttcatgcttaagtgtatcaattacatattgacaccatttgaatgcttctgcccgatgcggtgctgccacgcctacgaataccgcgatatcagtaagacccaattcgccagttcggtgagcgacaacaacgcgtcctccttgtttttcaatcggtgctgcaattttttctaattgtttttctgccattggatgataagcggaatactcaatcttagtagtctcgatctcgccagtccattgacgaacagtgccgacaaacatatcaattcctccgtactctggagcaacgagctgtttatacatttcacttacctcaataggctcatcgcttattcgtaaataatgcaacaataatcacccgcctttatcatgcttattattacacacgattatagttctttagaattagtcaaatccctaataataggattttaagagacttgttatactagcacctgaatgaaaggacgattaatcaatgaacactttaattctttacgatacactctacggtcataatttcgaattgggaaactttattcatcagactttacttccatctgccatttttctttcttttaaggaggccctccaagtaaaattggatagtattaatttacttatcctctgtccttgtacttatggcgaaggacagctgacagcatctgaagaaaagttctataattatctttgtcagttttctcccataaggctaacgtattatattgcaggtgtaggagacaagaattttggtccggcaaaatttgcaaacgcggtaaatatttttgatcaccaattgcatcaacatagcgcctcaccattagcatcttcattaaaaatcgactatgaagatctgccaactgctcaacaaacagttactgatgaaatcactaatttcttaagaaaaggaagagattctaatcactaatcatcattatcacataaccctttttactgcgattttattagttattatcgcaatagttcttgctctttcttgtggacggatttattattcaccaaccataatcattcaaacgctctttcacccacaaaacaatccagctgcagcaaacattatttttaaccttcgtcttccaagaatcatcagtgccctgttaattggcgctggtctagcaatggctggttgttctttccagagtgtttttcataatcctttagtttcacctgatattttaggggtctcatatggttcggctgccggagctgctagtgcaatcctcttgggctatggtattggacttacccagctctttgcttttgtttgtggaattattgcagtcagtttgactttattgattgcccatacccttcatcaacggggcaccttaattttagtattagctggaattgtgatttctggttttatgcaggcattggttggattactaaagtatattgctgatccagattcacaattacaaagtattgtctactggcaactaggcagtttagcaaaagttgatttttcgagtattattgctgttcttccatttttgattataggtacactaattctgtttgttcttcgctggcatatgacaattctttcgctcggtgatcagcaagcccgtttagaagggattaatgtggggatggaacaactactgataattaccgccagtacgtttctaactgctgcaacagtttgtcttagcggaaatattggctggattggacttgtaattcctcatgttgctcgacttttagttggtgataatacaaaagaaacccttccccttgcagcagttatcggcgcactctttttgttaattgtcgacacaatggcgcgatccctatcggcaggggaaatcccattaagcattctgactggtttcatcggcgcccccctatttgtttatattctaattaagaagaaggtgcaattaaattgaaagtcctcgaagttaataaccttagttttgcctattcaaaaacgcacccagtctttcacaatgttaactttagcctcgaagctggagaggtatttactatccttggccctaacggtgttggaaaatcaactcttctccactgtttagtcggacttttgacaccgaatgaaggaaccgtaatagttaacggaaaagatcttggaaatttgaaacacaaaacgcttgcacaacaagttgcctatgttcctcaggattaccatattaattccaatctaacagtgcttgattatctattaactggccgtgcaccctacctttcttttcttcaaaccccgcaccagaaagatgctcaacttgctgaaaactatttacagcgatttcatctttcgccttttcgtgatcatccctttatttcattaagcggtggtcagcaacagctaattacgattattcgagccctgcttcaagaaccacgcttgttaattctcgatgaaccaatggctgcccttgacttaagtcgacagtacgaaatattaaaactaattcaagacctagctcagcaaaaaatcactattattcttactacccaccttccagatcatgctttaatgttaccaactacaattggccttcttgattcaaagggttccatgattactggatcacgtgaggagttaatgacaactgaacagttaaaaagaatctatcatgttccactaactcttacttaccttccacaattacaacgatatacttgtcaaattaagatatagttaaaaacctctcctaacttggataatttccaaatcgggagaggttttttagactaattttcgccggccaaaatttgctttgcctgtttagctgttaaattgtagtggtaatatttttgatagaatttttgcacttccgacaccatgttaacattcttcatttcttggggatgaagaatcttagctgcccataagacttgaagtgcttcttctgcactataacgatcccatggaaaggtaccttgaggatttccgtatactttgttttctcgcacagccttcaattggtttagctgacgattggcacgtaatgcttttcgcgcatgagcagtagacgtactgccaacgataattatatctggatttgctttgattaattcttcaggcgtgactgaaatctgatttccctttttagaaatagcattctttccacctgccagtttaatccattcgttaacaattgttttttgcccgtcaaccttggtaagatctgttgaattaacaatatgaagaaccgttggcgttgattcgcggctcttcaaatgctgcttaacaaggttaatattgtttgttaattctttgttgtattgtcgagcaatccttggagaatttccacctaaaacatttgcagttagtgtaactgacttctttaacccagtaaaatcggtatacattgcattaattgttggtaattttgcttgacgggattcctttatttgagcttgatcggaggcaattacaacgtccgactttgtctttaccaattcttcaacttgaatttgattgcctgctaatggtgcagcaactttaacaatttttggatctactactgtgaaccaatgctgtttcttaacaagcggagtagtggcaactaacttgttttgtccccctaataacaaaacaacctgattattagcatgccataagtcagcaactcgattaactttattgggaatctttactttttctcccgtcatatcggttacggttcttgttgaactggccatcgctgaactgctaacaatactactaaacagtaaaaatattgctaaaagcttcaataattttttcatcatagtctcctatattttatttacctgaaatgtcaatttaagttagaaagaaaatagtcgctcatcagtgacgtaagacatgaatacttcatatggagttcgatagcctagtgatttacggggcaggttatttcgcttactcatcagttaggttaccaattcatcaggaagattgcgggaatctagctgtttcgttaagccatcccggcgtaaaagaccgttgttgttttcgttcagccctcgttgattgggagcaccaacctcggcaaagtaagtgtgaaggtcaaattgattggcaatctcgcgccagccggcgaattcttttccgttgtcaaaggtaatcgatttgaagaagtgccgcgagaatttccgaagccactgacttaagtgttggttaatcgcatcagccgtcttttcgtgcacattgagtacaattttgaccttcgattggcgttcggtcagggtcattaccgccccttggtgctttttgccttggacggtatcagcttcaaggtgcccaaattcagtggcatagtgcggaaagtccttggcacgctcgtgaatacttcgccccaattggccagccttcccgtggcgctcgacatagctattcgggtgccgcttacctcgcatcggcaagaaacggacatcgaagccgaactggccacgttcaaacatccggtaaagagttcgccagttacaactaattgggcgctcagcgcggccaataatggtatcaggcgtccacccctgggcaattttgtcgttgacataagtgagttcagccagtgacaactgagtacgttttcggccacaacgttgcttattgcgcatatagtgatcttgataatcagcaattgaggcaccggtttccaggtaacgataaacgcgataaacggtttcggcgcaacggttgatcatttgggccactcggtacggcacgaaagaatgggcgatgattgtcagctcgtttgtggtaagatgggtgtaagtcatttgtggtttcctttcttttgtttaggggtattcaaaagtctaccacaaatggcttttctatttttctaacttaattttacaaacggcgaataaaaaacgaaagatggctcggaaccccgtcttcgtaaagaaaggaccatccttcatgaattattctatcaaagctgctcttggaattaaagatccctaccttgaattagatacagcacactttaaagatacaattgaagatcaaggtaaccaggtaattgtgcatcttattcagtcttatcctttacattgcccgcgttgcggtcaattaatgctcaagaatggctttaagcttgttaaagtactgggaccaagcttgcactatgagccaactatttggtcaatttgtaaacaaaaatacctttgtaagccgtcactgaactgcccacaaacgattaccaaagtggctaaagttgaggacgttaagtatcgccatcatatcagtcaagccattaaacagcgagttatgatgcaactaacagttaatgaatcgcaaaccgatattgctaaggaacttggcatctctgattggacggtaagacgggttatctttaacctcgatcaattcttcaagcctaactaccactggctaccatgacacattgcttttgacgactttaagtctggtcgctttgtgcccagtggaatgagtatgatcttgatgaacattgaaaatcaccgtactttagacactattttgtcacgacgaagtcgctacttacgcaattactttctgcgttacgaccgctcggctcgtttagcggttcaaacagttacggttgacctgtacacaccttaccgtcatcttattcatgaattgttccctcatgccgttattattgccgaccactttcacgtggtcgcccaagcatatcgtgctttgaatcaaattcgtatcaaggctatgaatagagccgggaaaggtactcaccagtggcgagctcttaaacacttctggaaactaattttaaccccagcaggacttcttaaatatgataactattggtcacgccgtaattttggttacgctcagcttaccgacgttgaagtggttcatcgcttactgtctttcgatgatgatttaagtcaggcctatcgttattatcaagatctaatcttagccgttagtcatcgtgatcaaggtgaattgaatcagttactcagttaaaaatggaccacgctaccttggtcactccaaaaggttcaacgaaccttgcggatccataaattagagatcattaacagctccaaataccaaaactatactaatggcccagtagaagggacaaataacaaaattaaagtcattaaacgaaccgcttatggttttcgcaacttcttcaattatcgacctctcacaccaccgtacgtacggttccgtatacggcggttcgacaacttaatcacattgaattgactggagcgtcttggacatattcataagtccgagttgttccagttttctattagttagagaatagctcaaggtcttactatgtgcagttcgccagtagccctttcgggtactagcgaagacatatgcatcatgctgggacagccccaacttttgtaagttagttaccttagttttaaactttttccattgcttccaaatatactgccttattcggaccctcaaccacttgtcaaggcgttgaataaagttagttagtttcccaattgagtagtactgaagccacccacgcatttttcgatgaatttcttcaaacattcttgtcagagatattccacgattacgtttagttaataacttcagtgctttctttactcgttgttgcgattgtttagctggacgggcgtaggccccattgtggtctacacccaacgaaaagccaagaaacttcaaccgtagcgggctaccgactttggttttatctggattcactttaactttcaagcgcttttctagaaactgggtaatgcttcgcattactcgttctccggctcgttgacttctaacatagatgttacaatcatccgcatagcgcacaaagtggtgaccacgtctagtcaactctttgtccaactcatttagatagatgttcgccagtagtggtgacaatggccctccttgtggggttcctttttcactcttagcgaaaagcccatggtctaagactccgctagttagaaacttacgaatgagtcttagtgtccatgggtcatcaatatattgtcggagatacttaatcatcaagtcatgattaacgttatcaaaataggcttttaggtctaagccgacaactcttcgataaccttgattataaagatctactactttttcaatagcgtcatgggccccacggtggggacggaagccaaagctattatcagagaaaacacactcaaagataggcgtaagaatttgggctacagcttgttgaaccattcggtccaccaccgttggtattccaagtcttcttactccaccattaggcttcggaatttctacccgtttgactggagctggtttatacttgtcctcacgcaaactagcgatcagttccgtcttattttctctgagatatggcagaaggtcattgactgtcatatcgtcaacgcctgctgctcctttatttctcttaactcgcaaataagcctgattaaggttattgcgatccaagacctggtcttggatagtgacactcatacctttaccttcaccataaccggtactacgcgcccttgtgtactttcggttttccaaacctatcctcgacaagcggtcagcttgttgttctgttttctgcgattgtcgcacctgattacacctccgatataagttacaagttattgtcgttcagtccttcatctgattattcaaactactatgacctcggctgacttctggcttactcaacactgcatcactgcaccgcttgtttctgtggaaattaaacttattcctcttgtcggaaacgtgtaggccagatctccccgggtaagaatattagctttcgtaccatgtcatcgttagctttactgagaccaacttcgagtagtattggacttcaacttgtctagcagccttatccagttaatttcagccttatagctacttcttgttcatcgatgcagtactttgccttagacttccttcagattccacctcacggtggacacccttgtcctcagctcatggttccgactactacggcccatagcggactttcaccacctagctaatacccatgccgggcgcactaaaagaacagctcatgccaaattccagacacgagctgcttgaaaacttattctattttctcatcagtacttcttgacgaagcactaatctctttctcaaacaattacgaaacactacatagcttttaaaatctactaagctttagaataactaatcatgtttacgcttcttgcccaaaccaagcatagcagtcaagaaagccaatgctagaccagcaagtgcagtattagaatgctcattaccagtctgtggaagttgattaagattggagttagttgatgcattaggccttgtagaagaaccaaagccgttttcagctcctgattgattagtattttggcctggttgttgctcaggtgtttggcctaagatttctggtgtctgtgctggcttaatttcataagtaaagacaccagtaatactgcttaagtcataatttggattaatcttctttagtgcagccttaccagcatccgtcaagataatccgataagttcctactgccgttggtgctaagccatcagctgtttcccaagcgaaatcatctatactccatgttggcatcttcaatgaagtaccatctggcaacttactccacgttaatttacccggattaatcgttccaggttgaccatcatagactttcttatcatagcccttgtaatttacagtcacaatccctagtggattaatcgtgtaggtgtaactaccgctaattgtcttgagatcatagttcgggttagccttacgtaaggctgcttctccggtcgtattcaaactaagtgtgtacttaccggcatccgttggtgccttcttatccgcagtattccacgtgaagtcagcggacgttaaggttgaagtgttcagtcctttcaagccactccactgaactgtcgttggctcgaagttagctgggttaccatcgtaggtcttgctgtcactaccactataggtaactttatcaatccctagtggattaatcgtgtaggtgtaactaccgctaattgtcttgagatcatagttcgggttagccttacgtaaggctgcttctccggtcgtattcaaactaagtgtgtacttaccggcatccgttggtgccttcttatccgcagtattccacgtgaagtcagcggacgttaaggttgaagtgttcagtcctttcaagccactccactgaactgtcgttggctcgaagttagctgggttaccatcgtaggtcttgctgtcactaccactataggtaactttatcaatccctagtggattaatcgtgtaggtgtaactaccgctaattgtcttgagatcatagttcgggttagccttacgtaaggctgcttctccggtcgtattcaaactaagtgtgtacttaccggcatccgttggtgccttcttatccgcagtattccacgtgaagtcagcggacgttaaggttgaagtgttcagtcctttcaagccactccactgaactgtcgttggctcgaagttagctgggttaccatcgtaggtcttgctgtcactaccactataggtaactttatcaatccctagtggattaatcgtgtaggtgtaactaccgctaattgtcttgagatcatagttcgggttagccttacgtaaggctgcttctccggtcgtattcaaactaagtgtgtacttaccggcatccgttggtgccttcttatccgcagtattccacgtgaagtcagcggacgttaaggttgaagtgttcagtcctttcaagccactccactgaactgtcgttggctcgaagttagctgggttaccatcgtaggtcttgctgtcactaccactataggtaactttatcaatccctagtggattaatcgtgtaggtgtaactaccgctaattgtcttgagatcatagttcgggttagccttacgtaaggctgcttctccggtcgtattcaaactaagtgtgtacttaccggcatccgttggtgccttcttatccgcagtattccacgtgaagtcagcggacgttaaggttgaagtgttcagtcctttcaagccactccactgaactgtcgttggctcgaagttagctgggttaccatcgtaggtcttgctgtcactaccactataggtaactttaatcctctttcggtaataaatctttgtgtcactacttaagttatgaggaagaacgatcgtttcatctggatttacagctacataaccatcgataactggcgctttttcatatgggctagtggctttggaagcatcatctggatcattaacatattgccatccatcgtttattttatttccgttttcatcaacaggaataactgaacctaacttagcatactttaatatgacttcgtgagctgaactagtgacataaggattccgcgcaatccagttatgaccattaaagttaaagttatgcgatttaccagcaagaatattttcaggtccaacaattgttttattatctgcattaagaacactcacactcattgttccctgatcatcaatttgatgatacaagcccttaaagtcaacattaccatcattatcataatatgtctttaagtaataaccaccattctcaaattgggaaagagttcccatggacgccacattaggattttgaagatagtagcccttaaaaactttcttataattgttaataatatctgtaacgttaaactcttgacccgtaaacccggtaatgtaaaccttaggttggctaatatttgaaggtactccactatatttaattaccggtaccttttcataacttggcattatttcacaaactgatgttgcgtcagtattgcttggatcataatttcctaaactatatataatctgaaggtgctgcagttgccaatctggcattataaaaccatcatcgtaagtacttcctgtaacataaaaagttccatcaacataatgtccatttatagttgttggttctgtataagtaacactatatccagttttacttaattcataagtatcatttggctttactttaacaacaacagcattactataattgcttccagttacaaaaagatatacagacctatctgcagtatctttacgattcattgttaatattacatattgaaagtcactatcttttgtatttactaatttcaatatttggaaaatatacatatctttaagagatataacttcatctttattaacaagctgtccgctagcatccaattcaaataatggcccatacacatcgccacagtttggataattagtcggatctgttgctttaatttctaactcatcattagcttttgctgcatcactcgtactgctcttagctaaggattggttgagttgcgttattaaagcaggactgcttaattttgccggattaatttctgctgtacttgttttcccatcagtgactgaatcttttactgctgaccgagcaaatttattttctcccttagctagtgtagaatcactatcttcttcatcactagcggacttcacttgtaccgcagctgatgaggtaacattcttactagtccctgtggatgaagcacttaatggtgtacttgggttatttgtatcagtaacttgcaaatagagttgtggagatttttttaaaccatcctgagcagtcgtcgacgtaacacttgttgactcactgcttgctgtcatcgtgtccgcatgaacgctatccccttctagttctcccataaaggatagaccaattaataccgaagtaaccccaacagttaatttcttaatagtatagtactgttttgtaggtgtctgttttcgtatagtttccttataattttttcttgatagcattattaaccctcctaaatacaagccttaaaatttaaacaaaatttattttttaacactttcattctactttaccgcctgtaaatgatcaattattccaagtagacctttagaattatccttggatgaaaacacatcagcatctaaacaacattcattgtagcgagataccacccccccttgtggtcatttgcttagcgtaagtaacgatcagttcaatcatgattagtagcgagaccgccgttgacggaatcttttttcaatcagatagttcatgttgttaccaattaggatacaagctaatgtgcattagtcataactttaattggagactattaataattacaagtatcaagccaacattaatggcccacataatgagtaccaaacaataaactcaaaattattaaacaagtttctatagcttcttcatattttgagtttgcctctgcttctccttccccattgttatattgctatcaattggactaatacaaaacagttcatgcctaattccagacatgagctacttaaaaaatcattctattttctcatcaatacttcttgacgaagagccaatcgagtaggagataattgattagttcaattatcgacctctcacaccaccgtacgtacggttccgtatacggcggttcgacaacttaatcacattgaattgactggagcgtcttggacatattcataagtccgagttgttccagttttctattagttagagaatagctcaaggtcttactatgtgcagttcgccagtagccctttcgggtactagcgaagacatatgcatcatgctgggacagccccaacttctgtaagttagttaccttagttttaaactttttccacctgaaatgtcaatttaaattagaaaaaagttgaaagctgttcttttgtgatatgacttaagaatacttctaatggggtacggtaattaagtgcttttcgtggaatattattccggtgatgcatgagctgagtaactaactcatctggtaaatagcggaagtcaaggtgcttactaagaccgtctcgtcgaagaattccgttattattctcgttcaaaccacgttgattaggagcaccaacttccgcaaaataagtctgaaggtcatatctattagctatttctcgccatccggcaaactctttaccgttatcaaaggtaattgatttaacaaagtgacgaggcattttatccagccactggctaagatgttggttaactgcctcatctgttttgtgatggatgttaaggacaatcatcacttttgaaagccgctctactaacgtcattactgcgccgtgatgtgcctttccttgaacagtgtccgcttcaaaatgaccgaatttatgttggtaatgtggaaaatcatgatagcggtggtaaatactgcgcccaagttgaccagattttccacgtcgatccacataaccattggggtgtcgctttcctttcatcggtaattgtcgaacattaaattgatactgtccgcgggcaaacatccggtaaagagtgcgcatactacaactaatggttcgttctgcacggccaataatagtatccggggttcagccagctttaactttactattgatgtagttaacctccgctggtggaagttgagttcgtttacgaccgcaccgatgcttatggcactggtacgattcaagatattgttcgattgtttttccatcatttaggaaacgataaacacggtaaatagtttcttgactccgcttcaaaagtttagcaactttataggctttagtcccttggtgccaaaaatcagctatgagagttaattcacgtgtggtaagatgtttataggtcatttgtgatgttcctttacttttgtttgtggttattcaaaagtctatcacaaatggcttttttatttttctaacttaattttacaaacgacgttatatttaattatagccgcgttaaatcataaccacccgtcaaacgggtggtttgcacatcggctataagccgataataaaagccggcgtctcaaggcgctggctttcgctttgctcaagccaaaatgctctgactactttgccaccgctttaagcggtgtttatactacctcacttacccttaaaagggtccgaatattccacacttgttagcttatccattgctatatcatgtttctcttgatctcggatatacttctttatcgtggattcatttaatccaactgtactcacatagtagccttcagcccaaaaatgtcggttcccatatttgtattttaagtttgcatgtcgatcaaacatcattaatgcacttttcccttttaagtatcccataaactgcgagacacttagtttcggcggaatacttactaacaagtgcacatgatctggcatcatatgaccttcaattatttctactcccttatatttgcacaacaaacgaatataatctctcaggtctcttcggtattgattgaagatcgctttacgtctatactttggtatgaatacgatgtgatacttacataaccacttcgtatgggctaagctatttaatttattagccatatttatataacctcttttcccttattgactttggcttgaacacctacatcttaaggcaaaagaggccttttttatataatttttatcgcccacccgcatagcaggtggttttttgtttcgtgcactcgctctgctcgcgcactcaaccaggtctaaagacattaatataaataaaataaggatttttatctaattccctaatattttcttactcgttttcgtattaaaatcaaagaaaatggaggaatacttatgaagcgaaatcttaaatcagcagtatataaacacctaaactttgctaatgattttcaaaatttctttgattttccggattttcgtgaaatgagaccaattatccgggaagcagttcagcaacttgctaaagatcgcttttcgcaaccagtcttacctgttaaaattgagcatcaagcacttgcgattgaacaacaattagaacgagaaactaggaaatatcagcaacaagacggtttctatcctaaccagcagtctgaacttcataatttaattcgactctatactaacctcttacaaacgatcagtaagcgtaaaataattgaccaagagattgaagatgttatttatgccgtcaaccaaacccgtgaaagtctccgtaaactaaaaaagcttgaaggttctggagatttgtatgaggataatcaagataaggaacttgtgccgggaaccttttatgatattgtaacgcgacagctaatccgtccttacttgttaaatccacagggaaaaatgattccgaaaaatgttaattatgagggccgccaattagtagttcaaatgattacttattgttaccgtgattgggattcttatcttactcaccaatacgatgaacaatataacatcaaaaatgaacgtggcctgacaagcaacgagtattacgataaattagagaaaaatgaattgaaatatgctgaccatgcctatgctgaggtgattgcagatacatttaacgaatttaaaaaaattcttgttcctgaatatcttgccactttcgatattatgtcaactaacatcgagaaaattctcatccaatatcctcgtctccgcctgcagttcaatcaggcaattgcaaaaaattttatgctcgatacccatgggaaaatgcacgtaatggatgccccactccaagatataagaaataagtataactattaccgtgaaaactttagttaggagattttagatgatatgaaacccaaaattacacctgaaatgaaattggggatgaaagagtttgaaaataccatgtttatgctcaaagcaataccttgcgaagaaaatatcaatcgttttgcacttcaaggtaacctcatcccagaacgattagataacattgcctggttcttaccggcatatctttcagccgatttcaacctcttctttgtctttgctccaaacatcaataatcgttgggcaattagttgctcacaagttcatatcgagaatgataaccaaattacagcaatgagcgaaactgttccaacgggccttggcttgaatgcagtaaatgaattaagtcctagttccgcaattgaactggtagcttatctaaaaacactcgaagtaaatggattaggttatttcgacgaagaagtaggtaaagaagatgatgatcgataattcttaaatagccacttttttacaattagtgcataaaaaaccataaaaaacacccttcacattttcgtgaggggtgtcatcatccgttaatatcagatatctgatgtgcctgctatagttgccctttatttgtcgttaaactgacaattatgttcacaaaacaatattaatctctaaactttaataagataacttacaactctctatatcgaacttttactaaaaaaccacccataattcaaatcattcgataatttgaatccctaataacaagctttattatcaaattaaataaagcaagtattctcgaagtaatttttgatggagcaccttcaaatccatcaaaaatcttccctaatgaaatttaagcctctttctatcaactataaataaaaatcaatttagaatgtaactttaccgaaagtaatttttcttaatttagcgctattaatcataaattactttatatattaaaactaacaattattttatacgcatattacaagttatttagtacggttgaaggagtatatgaactgtattcagatactctaatttatttttgggtaaatgtattatcatttaagaatggagttaacattttaactaaattgattaattttatagcattctctaatgaataagtgatattcaaaggcctatactagttcattttacccgtaggttttctaataaaaataattagtaaatattaatcaactcctcttaattatttttaaaatttatattgcattttctggtctattatcgcataattgctatacatagctgttcgaaacatacaatctcatatcctgtgataattataattcactaataaattcaaaaaatgatgaacattaacttttgaaattttaataaaggaataatagctatgaaaaataaagattatacatcgtgtcccactatttactgatttatctaatgagggtaagaagtatcttgaaagtttattacattacaaaacttttgacaaaggagatcttattttttcaccggattcacaagatgagctaattattgttgttttaggccaaatgaaagtttataagttgaataaagatggaaaagaacatattatccgaattatcggcgctggagattacggtggggaaaattatttgttcgatctgcaaaatacaaccgtttacggaattgctctaaccaagactgaagtatgcatcctttataaagcagattttcataaactactaaaaatagaccatcaagttggacaaaatcttttaaaattaaatgctaaaaaatcagttgaattagaaagacaagcacaattactatctttttatcgtgttgatgttaggttagtagcctatttagaagatctttataatattaatgaagaagaaaattctattaccctaccgatgtcactaaaagacctcgcaagttatttaggtactagtgctgaaagtctctctcgttattttaaggagtttgaaacaaagggctggatcgaacgacattacagaaaaattattataaagccggctttttgggaggaatttaagtaggccttatgcaaataacataattttaatagctatttatatcctaactgttgatattaactaaatttaacattgaattgaagaagtcttatcattcaattgatttaaggtaagcagtcaataacagtacgtctagccctagctaccccgaatctcctatactgagactatcatcagtaaggagatttttatgtatgacagaacaaaatgaaattattaccccggttttcaaaaataaagcaagtgattttaagaagcatgtttttacggcacgccctgccgtaaaaatcaatgtaaatgaagtcgaattaactatttttaagggaactaattctattttggcttcagatatcgctaaagtggttattcgttatgctcgttaattggcatgatccacatcatatctatttagtctgcggaaaaaccgacatgcgaaagggcattgatgggctcttaatggtgattgccgaaaactatggattagaattatatagcaattcgcttttcttattttgcggtggacgtaatgatcgctttaaaggattgttttgggatggtgagggctttattatgctctataaacggtttgaaaatggccgccttagttggccgagaaacagtaatgaagcaaaaaaattatccgctcaacagctcgactggttattgcaaggactgaatccattcccaattcgtaaaattcaagctgctcggccgggaagcttttattgagttacctctatttaaaagaaaaattctttgatataattaccaaagaataattcaaaggaggtgacgtaccttgaaacaaacagcagaagaacaaattaaagaacttaaacagcaattagctgatgccaatgaaaaaattgctcaattaatggcaatcattaaacttcagcggaaccaaatctttgggaaaaaaactgaaataatggagtccgtagtgaatggacaacaatcattatttagtgagcaagaaatggatcaacttcaagatcctgatatttcagtcacgaaagtgactgaaaagaagataaagcaagtggtgcgtcaccggaaagcaaagcaatctggccagcggaccacttttttagatggcttaccacaggttaacgaagtcatctcattaaaagatactaactgtcctcactgtcatcaattaatgaaaagaataggtcaacacatttatagtcgagaagctcggttaaagctagctgaattatattgtgtgaacttgattcaagaaacatataagtgtgatgagtgtattaattctaatggtagcgaggtattaattagtagcgagatgccccaaagtcttttaccgcatagttacttttcgagtactattttagcaaaagtagcagaattgaagtttaatcttgcattaccgtttcatcgtcaaattaagctttggcaagccatcggcttacaagttgatgcccgactattggcagcgaacatcattaaagttagtcaaacttaccttgaaccactgtatgattatttacaaggattagttaaaacagaaccggtaattcatatggatgaaacaccatttaaagtaattgatgaatctaatggaaatggctatttttgggtaacgcgatcaacgaaagaattcagtaaacatcaaattaccatgtttcattactataatacccgagcaggcaaaactattggacaaattcttggtcagcaatatagtggagtgattatgtgtgatggctatggtggatatagtgatcgattatatcctcaagcaaagtttgggtcatgtttagttcatattcgacgtgaattttaccgcattacatgtttattgaaaaaggagcaattgaagaattccaaagcataccaagttttacaactaatgcgaccattttttcacgaagagaaacaattagcatatcacactcataaggaaaagctagtgcaacgtcggttgcacgtaaaacccttgatggataagctctatgcctatttagaaaacattaactttcctcaaggacgtttaagagccgccattaacaatgctttaaagttaaaaacacgagtgtatcgaatttttgaagatggccgagtaccattaacaaataatcctgttgaacaagcgattcgtccatcaactcttattcgaaagaatagtttatttgcgaaaagtactgccggagctcaggcaaatgccattttctatactttggtggcaactgcaaaccagaaccatttaaatatctacaaatactttaagtatctttttgatcacttactaaaccgcaaggacgaaggacttgaggcttatttaccatggtcaaaaaaagtccaaacagaatgccataaataaaaacggggacatgaattaccactttcggtagctcatgcccctgattttttcaattcgtactgttattgactgcttacgatttaagctcttcataagcaaaaagatggcgacgttgagaaaaagcttttctcgtgtctccatcttttttataattcttcggcttgtttatacagcttcgagattacttttggcggtaaattactattttcaaggaagttaagcaactcatcacggttaattattcctgcttgaattccacttataatctcatttgacagtttaagatcttccaaattaatttccatttcagcaaccaatttagcaatatctttggtcattaacaattcataattagaccatccccggttccacgggcgccggatatttgtcgcaattaatactaacagtttaatcaatggttcattagttttatcctgtttaacactaaggctgtgctcctcgtttaaaaatgcaacaaccttattgatagcctcatttacacttgataattcaagtccataagcgctcattttcaattgataaagggataggaaagcagcgcctttaacatcgtccccagataatccatattggttagcaagcaactcttccaaatcttgttgatagttactgatattggcaaatggattaaatttattgtcaattaagacttctttttctggaatatagtatggaaggccctgttgatgtttataaaacgaaggaagtctatctccatctttaataagaagtggactaaagataaaaatttcaggagcaatatcaacatccctaaattcttctctaaagtcaataataaagtattccatcgtcatttcattgaatttattttggatgtattgatcgaatcgttctttatcaattgatggattttggccatgaataatttggtaagcctgttgtgcagaaataaggccatacaaagcaacaaatgatttgagatattcgtcaatcattttatcagtttgtggatcgaatactactggaagtttatctgattcactaaataatgaagcaagaaaatcttctattgtttgatcttcctcctcatcttcgtcaaagtcgaccggatctttttgcgtgtatacgagaatgtcatcgtattcattatcactaataatgtctttatcttttaagtactttgctagttttttcaacgaggccttaatattcgttcgttctgttttgcctactccgtgaaattccagttcatcaacactagtttgaatatcaagattaaaaatagtgctcaaacgataggcgacccattcattaagataaaattgcaagttatctcgatagcggcgaatagttttagtactataattatgtttagcatcagcaagaaagaggtctaagagttgattatttgcgtcttggatttgttggattgcattatcaactccatcggcagtaagtttttctccatctacctgacttaatttctttaacttattagtaatttcttttaagtacagttcttccaaatttacgtgtttaatgctaaacggttgagccatttcgattaccttaaccgtctcgcctttaccaacataaattctacctttttgctgtacctttttaagcaatgcttttgctaagtctatttcattagtgctagttttttgtggctttatgacattctgataaaaatcggttatagtttttacttgtagagggtgaatcgttttattgatttgccaatccccaccggttgctaagtaatctgtcaatgactcagcagacagtcctagctcttgccaaattattgctagttgcttctcaaaccgctctttaatcgtctgtttatttttagcatttacatcaaataagacaattgccatggtagtagcatcatttaagaaaatcatgttctttttgcgtttagcggtatagtaagtagcatgccatgaaaaaagcggattagctaatgctcctgccacagtctcttcactcattgcttgttgataagtattaaatagtttctgtgctttcttttcgacgttaataaacacttagtttcccccatctcttttcgtaatcattacatttccatcttttggatttccatagacttcataagcaccattgagcttaatttcccgatagtcttgacctgcatagtttcctttaatcgtatactttccatctggtaaggtgccaacaggttggaagagctctggtaccggctttttatctgtgacgataatttcaaattcgccgtctactcccccatcgctaaatgtcaacttttgactagtgtcatcattaataatgacaacttcagctttatcagtagtctgacgtatttcttcttccatttctaaattctcctacctttttatttattacattttacaattatcattcccattttgccaattatctttattgatattcataaagaataatttgcggtatactattaatagacaatttattgcattaggggtgcccatagtgctgggctgagatgtgcagagacgcatggactctagaacctgtaagttaacgcttgcgtaggaaaatgcaccgaactttaatactcaaagtaggtgtatttcctaccttgagtattttttatttaaggagctaattttatggtacaacgtcaaattaactggtcactaatcgatcgggttcgtgctaaaaatccgattgtccttaacctggccaatttagtaacaattgataaagttgccgatgccgttagtgctgtcggagcgtcgccaatcatgtctgttgaacctgctgaagcggatgaaatggtgatgctagcaaatgccctttctatcaatctcggaacgattaatgaacatcaggcaacacaaattagaacggttctgcgagctgccacgccactaaagcccctcgttttagatccagtagcggtaagtgcggttccatcccgcttaaagtttgcccactcattgctaaatgattttcattttgatgttattcgtggtaacgccagtgaaattgctgctttagtagaagctgacaatactagtcatggaatcgacgctggtaaagttcctaatcaggttcaaattgccgaaacgtgtgctcgacgttaccattcaattgtagtcttgactggtgaaactgacataataactgatgggcaagttgtctatgaaaatcccttttctgccgagatgttaacgatgaatgtgggtagtggcgacatgctttctagtatcatcgctgcatttttagggattactactaatacttgggatgcatgtattgttgcaacggttttggtatctgctgctggagtattagctaaccgttattcagtcggactcggttcgtggcaagtacaattttttgaccagctttcgattatggatacgaaagcattactagaattctttgatgaaagtgaggaagattaccttgattaatgattatccccaggctctaacaattgctggaactgatagtggcggtggtgctggtattccagcagatgtaaagacgatgcaaatgcgcggcgtatactcagcaatggtagtcgtagcagtcactgcgcaaaatacattaggagtgcaagatgccctgccaatgcctgaaaaattaattgatgagcaatttgcttcaattgctgatgatttgaaaatcagggcttgtaaaacggggatgctggctgaccctatccgcgtaagagcagttgtccgaaatttaaagaaatatgatttaggaccgcttattgtcgatccggtcatggtagcaaaagggggcacaaagttacttagtgatgatgcaatttcaattgtaagggatgaacttatccccctcgcctctctggttacgccaaacattccagaagcttgtgagttgacgggaattgcaataagggataaaaatgatattaaaaaggctgcccgcgaattacaagagcgcggagcaaaaaatattctcataaaaggtggccatgcagaatcttcagacaaggctgatgattatattttatttgaagatggtaatgatatgtggttaactgcgcctcgtgttaatactaaaaatactcatgggactggtgatacaatttctgcatgtattactgcggaaattgctaagggtcactccatggaacaggcaattatgattgggaagacatatgtcgaaaagacgattagtaagggtattaatgttggtcatgggcatgggccacttaatcactgggttaaaattgaaggagacgatctaaaatgatatttgatccaaaaatgttacaagtatacttagttggtggaacacaagatgttcataatgacgttgttaaatttctcgaaaaagtggagctagcaatgaagagtggtatcaccgccttccaatatcgagaaaaaggaaactcgaagttacggcctaatgaacgagtagacttaggactagaattacggaccttatgtacgcactatggaattccattgattgttgatgacgactatgaattggcccagcaaattaacgctgatggggttcacgttgggcaaaatgatactaagattgaacaggtatctgtcgccgtaggtcatcagatgttcattggctactcctgtaatacaccagaacaagttgaacgtgctaatacaatggactttattgattatatcggttgtggtcctgttttccctacaaaatcaaagtctgacgccgatactgctattgggatcaatcgtcttgaacgtttaaacatgatcagtgagcgtcctgtagttgcaattgggggtatcgatgaagaaaatatgaaagttgttcacgacactggagttgcaggtctagctgttatttccttagtctttgatagcaaggatcttgtagcaactgtaaagaaaatgaagaatttgtataaataaaatagcaaggttgaaagttgaagggatttctctttcagccttgccattttattaggtaatattttttactaaagattattttgtccttgcttttgcttcctgcatccattttgaaattccaattgaaattgcgactccaatccccaggggaagaaaagctgtaaagttaaggtgacaaacttcaaataacataaataatgccattaacggtgcttgttgtgatgctgctaaaaataatgaggccccgataactgcacactgcgttaaagtcacaatcgggaaaaagtgcatataaggaataccgagaaatactccaataactgctccagcggcaatcgatggcgtcagtgttcctccatagcccccacatttgattgtaaatagggtaaccactactttagcaacgaggccaaacaagagcgctcctaggacctgggaattgacagtggtcgtattcatagctaattgagcaagtccccgcccgttccccataatctgcggataaaaggctgcaattgctcctgctgagaatgataaaagtggtaattgccagaaaatatttttacccgttgcccgtttactagaagctgctttaactccttgtttaaaccaggttccggttactccaaggattaagcctaatacaattgctaatggaacggatagcaaagagaaatcacggcttccgacaatataatatggttcgaatccttttaaaattgaaccaatcatcgttgcaattactgacatgattaagctaacggaaactgaacgagtattaatgcgccggtataaaatttctaaacagaaaacagttcctgtaataggtgcaatatagacccccgcgaagccagctccagcagcagcggcgattaataaacgtttatcttcatcattgatgtgcaaccatcgataagaatcaagcactcgggaccatttctgagcgatagccgcccctgcttctcgtggggctaattcacgaccgatcgagttcccagtccctacaaaaaagatctgggtaactacgtgaataaatgtttttcttaacggcatctctttaccatttagggcatttttaatgctaactggatgataatggcgctgaagaaagtaccaaataatggtagcgattatcccccctattagcaccgagacaaatcgatgaataggaaaaatattaatattaaccggaatcttatttgtctcgttaaaatttaaaaaataatgctctgttaaatctagaatagcgctaaggatcaatgagctaaacccaacgactattccaagaacaaccgttgcaatagctaatgaaatgttctcttgcgtttctttcatcttttcgtctcctataaaaataaatcaccttccagtttatcacggatcaatgtaaaaagataacagcaatcttttaatatgttggatattatgtaaactaaaatacgaccgaagaataagcgctaaacttctttctcggtcgtatttctatctcagactattgttggacatacgtctgtgtttgtggatcaaattcaaatgtcaatttttgatcatttaattctacaaagatctttcgataatttttatcataaccattatgaagcatatctattgttgctccgttttgagaagccttgatttgataaaggttgtattcaccgccttggtaagcaaagtcaaggccattatcttggtaatgaatatatgaggcatgttgtccatataagcggaaggtcattgtttcattaggttcatcactaatatgacttacttcagggccccatggaataatcgtattctttttaacgaataatggtaacttatcaattggcgtttcgactaaaattgaccgcttacctgcatattcaacaccgttccaaaagtcaatccactcccctgctggcaagtagactgctcgcgtattttggccttcttggactactggagcaactagtaattcatcgccaaccatatattcatcgttcattgtccgaacagcagggtcttgatcgtagtttaatactaacggacgcattattccgagcccattctttgtttccttgtaacaaagatcgtataagaatggaataaaacgataccttaactttaagtacttccggtagattgaaagcgttggttcaccgaatacccaaggttcttgtgcacgggttcccattgaagcatgattacgatagagaggactaaataaggctgcctcaatccaccgtgtcagcatttctgccgtcgcatctgcaccaaatccaccaatatcagttccagcaaaggtgaagccgctcattcctaaattacataattgaggaatcatcatttgtaaatgaggccacaaactttgattatcccctgtccagacggttgaatacttttgcgttcccgcataagccgcccgggtaatgacataaggtcgtttatggctgtatttctttaatccattgtaagtagcctttgccatattgtgtccgtaaacattatgcaatttcttatgggtagaaaggtattttccatcactaaagacaatgttgtcaggaatttcaccttcaaatgatgctggttcattcatatcgtcccaaattccagccgttccggtatcaacaaggtatttacaattatcagcccaccattgttgtacctcttctcggccaaagtcagggaaaacagcatcaccaggccaaaccttattaacataaacagttccatcaggattcttaacaaagtatcctttcttaattccttctttataaattttatactttttatcttgcttaacaccggggtcaataatcggcattactctaaatccttggtctctcaactttgaaacaaatgcttgaggatcagtaaacttttctttgttccaagtaaatactcggtaaccatccatatagtcaatgtcaaagtggatcacgtcacagggaagatcattttctcgcaatttagtcgcaatctcttgaactttttcaggacttacactatacccccaacgtgattgctgataacctagtacccatttttgtggcaatggaacgcgcccagtaaggtaagtataatttgtaacaatatccctcaagtgcgggcccccgataatgtaataatcaagattaccggcaactgcagaataaaagtagtaattgacattttcttttcctaaatcaagatgactacgataaggattatcaaagaagagaccgtatggatgaccattctttaaacctaacataaaaggaatagacttataaagccgggtaaaactttctacttggggtgctggattatcagtgttccagttatcgtattcgtagcctcgtttattcaagtacccggttttatcgccaagaccatatatctgttcatcagtagctaaagatttaattacctcaaaatatgtcttatcctggtcacttccaccagcaatatcgtgaccttctgcagcaactaattttgcatgagcctcatctaatccacggtcaattggtgttcgtttgccctgataatcaataattaatggatgaccatctttgtcataaacatctattttctcatcgtcgtatatttttacaattaacgccgccgtagttaattcaagatggtcaccatgatctaagacagtaaagttagttttaattgttttgttgccttcaatagcatatgatgctcctttttcaccgtgatcttgaaatacccgaataatttcaggcgtaataactgataaaacaattgaactgttttgataattaatcgtaatcctttgatcaacagttgcgtatccacgtaattggttattcattaatgtcgcccttcctcttttttacttttattgtatcgcatttattttaaatgtaaacgttttcgtgaagggggaaataactttttaagaataaataggatataattaaatgtgataacgaaaatgaatgaggcttataaaataatgcataaaaaagcacaaattggattcggattcttttgttggattttattcggaatattactcttcaatgttttaactaaatctctatttattcgttcaatcgatacaagtggttttgcgctgactgctccagtatctaaagtcaaaaccactatcttaactgaattgacttttatgggtgacccagttacagttggaattataacaatcggcttaatgcttctattatggcggcgcggaagggcaaccgatagcgtctggtatggcatgttacaatttattggttactgtttagttatcttcatcaagtatagcgttactcgtcttcgtccctcctttcggttaattgatgttagtggatatagtttcccaagtggacataccttttcaactgctattttcacttttacgatcctagctctccttttaccctattgtaaagttaagtggcagaaagtaatcttagcaatcgtcggcgctctatggatcattattattatgtattcgcgagtttatttacgagctcattttacttccgatgtgatcggggcctttttattagctagtggatggtggtcattagctaatagtcagcgcgctattttctttcattggctacaaaagccagttaataaagtctaattatcaaaacaccaaactataatcgatataaaagttatagtttggtgttttactttaattgaaataaattttaattttcaaatattcgtaagcagtccatattgacacgtctagccatcaaaaacttagtcttctatactaaaagcaatcttagtacaggaggctttttcttatggaaggaaaacacgatattgtatcaccaatttttaagcccaagaattcagttgttaataaggatgaatttattcctcggccagccgcaaaactacaagttgataacattgaattaacgatctttaagggagctaatctcagtcttgcgactgatatagctaaagtggttattcgttatgctcattaattggcagacaccggagcatgtttaccttgtttgcggtaaaacagacctccgtaaaggaattgacggtttagcgatggtagttgcggagaactttggactggagttatataataattcgctttttttattttgtggtagtcgcaacgatcggttcaaagccctttattgggatgacgaaggcttcattctgctatataaaagatatgagaatgggagtttaagatggcctaagaacaaaagtgaagttaaagaactaaagccagcgcaactaaatgccttatttacaggtctatccccattccccgagcgaagcattcataaaattaaaccaggaagtttatattaagctctttttaaactgttttggctctgatataataacaaaagtttattagatcggaggtgacgtacaatgactgaatcattaaagaaacaaaacgaagcactacgtgcgcagttgaagaaagcgcaagaacaacttgaacgacaagcagctacgattaagcaactgcaggaaataatttttggaaaaaaaactgaagttttagagcaggtagctgatggacaactatcactatttgatccagttgatgatctgaacttggatcaagagattactgaagtagttaaaacaactacgactaaggtcgtacgtcatcgaccagcaaagaagcaactaactcgtcaagagtttttagaccaacttcctcaagtcgaggaagttgtttctttaaaaacgactgcctgtccagattgtcagcacaaaatggctcatattggaaaacgattggcacgacgggaagctagactaaaagagcccgaattgtattgtgccaacttatatgaggaaagctataagtgtaaacactgtagtcaagatgaaaatgataaattggtaactagtaaggcgcccatggctttattaccacatagttacttttcaagcagtactatggcattcatcgcctatttaaaatttaatctggcgttgcctttccatcggcaagaaggttttgtacaagggctgggattacctgttagtgccaagcaaatggcctcgaatattattaaagttagtcaaacgtacttagagccgttgtatcagtatttaagcaatataattagacaagaaccagtcattcatatggatgaaacaccttttaaagtcgttgatagtcctaaatcccaagactatttctgggtaacgcggacaacgaaagagtttgcccaacatccggttgtagtctttcatcatgccaatacgcgttctggtagaatcattggacaaatagtcggtaataattatccgggtattatcatgtgcgatgggtataaagggtatagtaatcaactctatccgcaagcaaaatttggttcgtgcttagtgcatattcggcgagagtttgtcaaactggttaaggcacttcccaaaacaatgaaggcgtccaaagcgcaacaagcaataactcttcttagtcaggttttccattcggaaaaccagttgagttatcaaacggctaatgagaagttagtgcaacggcaaatccatgtcaaaccgctaatggataaattttacaattacattagccagattagccagccgattggacagttgcgtaaggcaattcagaacgccatccagttaaaatcacgagtgtatcgtgtatttgaaaatggacaattaccgttaagcaacaattcagttgagcaaagtattcggccatcaacactaattcgaaagaattgtctattcgcaaaaaccgaagaaggtgccaaggcgaacgccgtctactatagcttagtagaaacagctaaactaaaccagcttaacgtccagcggtacttaaaatacttgtttgatcacctaccagagagcaattgtcaagatctggcagcttttttgccgtggtcaaaaagcgtacaagaagaatgtcacgaatagaaaatccccgtgaagccatcaaggacgattctacggggattttttgtctgtcaataatgtgtcaatatggactgcttacaaatattcgataaaaatagttaattcgacttcatttacattgatttttacggcacggctctgccgtaaaagcatgcttcttaaaatcacttgctttatttttgaaaaccagaataataatttcattttgttctgtcatacataaaaatctctttactgatgataatctcagtataggagatcaggaggagctagggctagacgtactgttattgactgcttactgataagcttactaaaaaaagatatacactgtattaaacaatgcatacccttttttatattgcgcggcaacgtcctatcctcgcagggagcgatcccccaactactttcggcgtgttgaagcttaacttctgtgttcggcatgggaacaggtgtatccttcaagccatcatcaccacactctttgtcccttcggacgagagcttgtgctctcaaaactaaatcctatctattctcttccaataaaccttaccgctccttggttaagtcctcgaccgattagtaatggtccgctccatgcctcacggcacttccacttccatcctatctacctcatcatctctgaggggtcttactttcccgaaggaaatgggaaatctcatctcgaggcgagtttcacacttagatgctttcagcgtttatctcgtccatacatagctacccagcggtgctcctggcggaacaactggtacaccagcggtatgtccatcccggtcctctcgtactaaggacaggtcctctcaaatttcctacgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccagggtagcttttatccgttgagcgatggcccttccatacggaaccaccggatcactaagcccgactttcgtccctgctcgacctgtctgtctcgcagtcaagctcgcttgtgcctttacactctgcgcatgatttccaaccatactgagcgaacctttgggcgcctccgttaccttttaggaggcgaccgccccagtcaaactgcccacctgacactgtctcccagcacgttcagtgctgcgggttagagtggtcatattgcaagggtagtatcccaccagcgcctctgtcgaaactagcgtcccgacttctacggctcctacctatcctgtacaagcagtacaaacactcaatatcaagctacagtaaagctccatggggtctttccgtcctgtcgcgggtaccctgcatcttcacagggatttcaatttcaccgagtctctcgttgagacagcgcccagatcgttacgcctttcgtgcgggtcggaacttacccgacaaggaatttcgctaccttaggaccgttatagttacggccgccgtttactggggcttcaattctgagcttcgccgaagctaacccatccttttaaccttccagcaccgggcaggcgtcagcccctatacttcatcttacgattttgcagaaacctgtgtttttgataaacagtcgcctgggcctattcactgcggctggccttgcggccagcaccccttctcccgaagttacggggtcattttgccgagttccttaacgagagttctctcgctcaccttaggattctctcctcgactacctgtgtcggtttgcggtacgggcagttaactactccttagaagcttttctcggcagtgtgacatcggcaacttcgctactttaatttcgctccccatcacagcttgtcaacacggatgtaaacatttgactcacatcctgacttactgcttggccgtactcttccagtcgtacggtttgcttagcctcctgcgtccctccatcgtcaaacgcagttaactggtacaggaatctcaacctgttatccatcgcctacgcctctcggcctcggcttaggtcccgacttaccctgggaggacgagccttccccaggaaaccttagtcattcggtggacaggattctcacctgtctttcgctactcataccggcattctcacttctaagcgctccaccagtcctcacggtctgacttcgccgcccttagaacgctctcctatcacgtgcacatagtgcacatccacagtttcggtaatatgcttagccccggtacattttcggcgcaggatcactcgactagtgagctattacgcactctttaaatggtggctgcttctaagccaacatcctagttgtctatgcaactccacatccttttccacttagcatatatttagggaccttaactggtgatctgggctgttcccctttcgacggtggatcttatcactcatcgtctgactcctgagtataaatcgatggcattcggagtttatctgaagttggtaacccatgacgggccccttgtccaaacagtagctctacctccacgattctttacctcaaggctccccctaaagagatttcggagagaaccagctatctccaagttcgtttggaatttcaccgctacccacacctcatcccagccattttcaactgacacgggttcggtcctccagtgcgctttaccgcaccttcaacctggacatgggtaggtcacctggtttcgggtctacaactacatactttttacgcccatttaagactcgctttcgctacggctccggtttttccaccttaaccttgcatgcaatcgtaactcgccggttcattctgcaagaggcacgccgtcacccattaacgggctccgacagcttgtaggcacatggtttcaggaactatttcactccccttccggggtgcttttcacctttccctcacggtactggttcactatcggtcactagggagtatttagccttgcgagatggtcctcgcgggttccgacggggtttcacgtgtcccgccgtactcaggatcctgaacagagagtgtgacgtttcgtctacggggctttcaccctctatggcacagcttcccaactgttgcgactacgtcgcactttggtaactctaatgttcagtcctacaaccccaacaagcaagcttgttggtttgggctcttcccttttcgctcgccgctactcagggaatcgatgtttctttctcttcctgcagctactaagatgtttcagttcactgcgtctacctcttgctagctatgtattcactagtcaagtaatcagcgactaagctgattgggttgccccattcggaaatctccggatcaaagcgtacttaccgctccccgaagcatatcggtgttagtcccgtccttcatcggctcctagtaccaaggcattcaccatgcgcccttcataacttaacctaaacaatcaaagattgtctgattaattgagttagcgattataattcgttaattaaaactcaaataacgcggtgttctcggtttattgttttgttaataaagaaatcagatagtatttagttttcaaagtacaagctctgagggtaaacccctcaaaactaaacaaagtttcttcgatgtgtaggttccgttttattccttagaaaggaggtgatccagccgcaggttctcctacggctaccttgttacgacttcaccccagtcatctgtcccgccttaggcggctccctccataaaggttaggccaccgactttgggcgttacaaactcccatggtgtgacgggcggtgtgtacaaggcccgggaacgtattcaccgcggcatgctgatccgcgattactagcgattccgacttcgtgtaggcgagttgcagcctacagtccgaactgagaacggctttaagagattagcttactctcgcgagtttgcgactcgttgtaccgtccattgtagcacgtgtgtagcccaggtcataaggggcatgatgatctgacgtcgtccccaccttcctccggtttgtcaccggcagtctcactagagtgcccaactcaatgctggcaactagtaacaagggttgcgctcgttgcgggacttaacccaacatctcacgacacgagctgacgacgaccatgcaccacctgtcattgcgtccctgaagggaacgccttatctctaaggttagcgcaagatgtcaagacctggtaaggttcttcgcgtagcttcgaattaaaccacatgctccaccgcttgtgcgggcccccgtcaattcctttgagtttcaaccttgcggtcgtactccccaggcggagtgcttaatgcgttagctccggcactgaagggcggaaaccctccaacacctagcactcatcgtttacggcatggactaccagggtatctaatcctgttcgctacccatgctttcgagcctcagcgtcagttgcagaccagacagccgccttcgccactggtgttcttccatatatctacgcattccaccgctacacatggagttccactgtcctcttctgcactcaagtcgcccggtttccgatgcacttcttcggttaagccgaaggctttcacatcagacctaagcaaccgcctgcgctcgctttacgcccaataaatccggataacgcttgccacctacgtattaccgcggctgctggcacgtagttagccgtgactttctggttggataccgtcactgcgtgaacagttactctcacgcacgttcttctccaacaacagagctttacgagccgaaacccttcttcactcacgcggtgttgctccatcaggcttgcgcccattgtggaagattccctactgctgcctcccgtaggagtatggaccgtgtctcagttccattgtggccgatcagtctctcaactcggctatgcatcatcgccttggtaagccattaccttaccaactagctaatgcaccgcaggtccatcccagagtgatagccaaagccatctttcaaacaaaagccatgtggcttttgttgttatgcggtattagcatctgtttccaaatgttatcccccgctccggggcaggttacctacgtgttactcacccgtccgccactcactggtgatccatcgtcaatcaggtgcaagcaccatcaatcagttgggccagtgcgtacgacttgcatgtattaggcacaccgccggcgttcatcctgagccaggatcaaactctcatataaaatatataagaacttgaatagctctcaattatctttgttattaagcgaattgacttcgcaaatgttttgcttcaaatcacatcgtgattgaagaccctacacatttgattcgtcgaaactttgttcagttttcaagggtctacctgttggccaatcaagcagccagtcaacatattcattataacatacatcagattagcttgtcaagaagaaattttaatcaattttgaatttcttttgattgataactcaatcagcaactttattaatatatcatatcgtcaatgggatgtcaacaatatttttcaaattattattgagactttgcagctaagttaaataaatctaagaagctacaagcgatcatccatctcccatcgctgacaggaattttattatatcctatctctaaatcctttgcaagcatttattttattttttatgcatatcattcaaaaattgttgaaggtttaactcttcattaactttttggaacgtttcggtattccaaccattactacctgtaacaattaatttattattatcaagcgttgcagtaaggggattagttacgtcacgatcttccaaatttataaggtagtgttctccttctttacgccaagttaagctatcatttgtatccggattattcttatctgcataaacataccgacctgttccgttttcatttaagacaatagctgcaccgtcttgatcatctcgatacgatccaacaactttttcagtctttgttattttaggcgaatccttctttactactttattatcacgaactgggttaagttgcttactagcaaaccgtttataatttacccctaaaactcctaacaagattaccagtaatatagtaaatataattaacccaatatgggatcgtttctttttagtacttttcaccattatcaccccatccctcctagtattatctcatcatttcagtaaatctgtcacatcttttttagctgatcttttcttttcttcaagttgaataaattctcgaaggtatttaaatggaaaaggaattactgttaattgatggaatcgtacaaaattcaccatcatcagttgaagaaacttcaagatgttttcggcctcaatcgtagcgaaaccacgctcatttaatttaatgttaggctgaagttgccagatgtgtgatgtctttgcaattgacatattcatatttttactaatggttcctacattatagtaaataacatcctgatcgtcgttatcaacgaaataattaatatcggttaacccagagagatacttttgaacatgggattttatttttggtttcactttcaaaactagtccatattgttcatataattcatccaataataaattaattgcaattggacttagtattttattcttcttcataaaatcaaattcattttttaagtcattgatgttaaatgaatctagctctcttttattaatgatagaaataagattttggtatttagttctgtaattagggtaacttttacttaaatcattcaaagtccgtttaagttccgcttttgttactgatgaacaattttgatgactaatcatctcgttgatatcgctaaaaagctcagcattaggcaaggtaaagatatttttcctatttaaattgtagaaagtattggcaggagttttaattaggtactgaagatctgcatcatcggaattaacaaattttgagctttcttgtaaatctaaccgtctcacctcgaattcatcactattaatcattttaaatagatagactgcttgggtaccataagctccctttgcaacttgataaaactcccatcccaccattgaatctggtgaatgatacagacttaagcttctttctttcaaatctttctttattatcaactcttttaatgaattaattaacgtacttcttagagcacccttcctaaaggtatcaattgtcaaatgttgtactattgcctgctatagtctctcgcataattatctttaacatcttcatgagtttagaaataccgcttatcattaatcaccactagattatatccaaatttatcttcaacggtcggtctaatattgactttaacggttggcaaaagctgaaccaacgcggccttgatatcttctatccgttcatcccttgcaatccgattgtcgattaagtttaactgattcgtcgcaaagaattcttcgatatgcttgtctaaccaatccctgccatgcttcgtctcgattctgtctgctaggagttatgtagataatgacatcggagttcttacttttcattagcatgtccgttacccactgcagaccacccgttgtttttccagaaccagttcgattttcaaataatgctaaacctggaagctgcttttcagcaatttcattaaacagcttaaccgttaaattttccattggcactatctcccttctaaaaaagcaaaaagggctccttgctgatcaaagagtccccaaataataattcaataattgcaataaatcatatatgttgctgaaagataattcattttacttatttgctgctattttctttcccttatttacatagtgaagtgtaccaatcggaccatcaacgtgaagtttgccattcttataaacaagtttggttactgccgcattctgcattggctttccatcatattttttagaaatagttgaaagatattcattaattgacattccagaactaacaactaagacattgccgccaccctgttcttgagtcgtttttgcaatgtgaagcaattcggaattcatccgtttttgaacctgagctgaactttctgcccgatcacttttagccaacttggtattttgcgaattgtccatatcaagtttgtggtaggcatcttggagcttattccagtaatctttgcctgttgcttgctggaactgcttgccatcttgataaccataaacattagcaatcttctggttatcagcttcaatactatctccttcaaagctgccgtatccgccttcacgtaacattggtgtggtcgtaatctttgtatttggattggcagaatactttaatgcttgctgtgcagtaacttcttgccgggttaagttacccgtgtaagcatgcttaaatttaattccctttaatccatagcccaaatcattagcaacagtaattccatttttggttaatggaaaatcactcgatccttgcacccgttgcatcacattaccagtagtttccccgtgacgtgtaagatagattgtcacctgcttatcattagaggctgcataggtagtagctggaaccaccgtcatcgcagagctccctaatagtaaacctgataaaacagcacacattactgttaattttttgaatttcattaaactttccccaattcttatcagattctttcagcaacaccctcattttacacatttttgtgagcgcgttcaataacatttttgtcaaattttaagaataagcatttgcaattgctcttttctttttccttaaaagaattacaatagtcgtgaggtgatgaggatgaaaattcttgtaacgaaaaataaagaagtagcaagccaaaacgcctttgaacttctccaaacagatattattaacggtgctcaggtacttggccttgcaacagggagttctccactaggtctttatcaaaagatgactagtagttcagctgattattccaaccttatttctattaaccttgatgaatatgtcggcctcaaaccaactgatccgcaaagttaccattactttatggagcatcatcttttcgcgcaaaagccatttgccaaaagttttattcctgatggcagtaatctgaacgccactgaagtaattaatcactataataagattttggctacttatcctattgatacgcaaattttaggaattggcaataatggtcatatcggttttaatgagcctggaaccccttttgatagccaaacccataaagtaaagttaactcctgctactatcaatgccaatgcacgcttctttacttcaagtaaggacgtgccaacggaagcctacacgatgggaattggttcaatcttgcaagcaaaacatatcatcttactcgcatttggtgagcaaaaagcagacacaatcaacaaaatggtcaacggtaaaatcacgaccgctgttccggcatcagctctccaacagcatccaaacgtaacagtgattcttgatgaacaagcagcaagcaaactagcttaaccagcacttttctgtaaagctatggtcttggcaataataccgacatccgattggtttaatccggcaatcatttccgcgttatctgccgggtaatcaattacctgaccatgatgaagggcaattaactgaatgaataatttagttgaccggccattcccttcacgaaacggatgaatataatttagatcatttaagagagcagcataatcctcaatggtaggctgctttttcttattcaatcgtccaatttcatcattaatatatttaattgcattatcaaaacgaccatattccaaaaaatcaaaacctgcctttgaaatatagtagttacgtaactcacccgcccagtcataaagccaaccaaaaaggaatttgttaattgtctgcaaatcttcaaagcttttaattttcggttgttgttgaagaagggccacttccctttctgctacaccacgatactcaattaaccttaattcatccgcgtttttaattgcaaacttattgcggagggttccattatcatataaaaattttgcttgaagttcttcatcagtcatcttaatcaccaaataattgctcaatttccattaaaatttcatcatctggattttcagcactctcttttaatcgccttacatctgttgctgtaggctcccatccctctaaaacattactttcaacagcaaaccgaacttgttgataagaagaaggtgtttggaactgcacgtgctgaatcgttagttgatcatcgtcagtatgcaggtgaaaatcaaagtcctgaatccgatctaataattctcctggacgctctcctaaagcatctgcaagtgcattaagaatctgaattgaccaggttgcaacgggacgtttaagtgtttcgttaacctgcgcaacgtcaaggccactttcttgagcaacaaatgtgactgtcatattattggtttttaaaatattgatgatgttttctgccatatctctactccatttttactttattgtttccattatagcgagaaaataaaataatgaaaaatagactgctaactcccacataatgaaagtaacagtctattttaagcaattaagcatgtttacgcttgcgatcaataattgtcaatccggttgctgccattaatgaatttccgagaagaagtaatgcaagatcttcatcgttaccagtttgtggtaaagctgcttgctggtcagttgctttttgtttttggccattaattgatgtaggcgtcaaattaattaattgattattagcagctacggtttgttgcttagattgagcatgtaatgtaacagtttcggcgggttgaccagctgttgttggcaaggttactgttggagataccggttggctcggaacttcttgaagctgatttccttcagtctgggaattagcatcgttttgagtgttctgattagttcctgtttgtgactgtgaatctgcgtcagccttcgctaattgttcagcagtcaagtaaatcttacggttcattgttggtgcggtaattggtttaccatcattagtcatatcagtaatataatcaataaacgcgtctgtatcttgcccgacaatcccgacaactttggtacccttaaatgcagaaaagccatctccgccacctgctaaaaagtcattaataacaacattgtaagtcttattcatatcaagcggttgattatgttggtcataaacttgaacgaccttatatggttggttaggatcgttttggtcagtataagtataatgaagtccagaaatttgtaagtagtaagcttgatcttcgtcatattgttgattcaaggcttcaactatttgtgcccctgtcatttcaactacccgcaaaatattaccaaatggttgaaccgcttgggcacttccccatgtaatggaacgatcaggattaacatgcagatctgcacgaacaccgcctgtattagtcatcgcaaaatcagctggtaagcccaccttatgagcggcatataattgaccatcgacaactaattcaccaacggcattttcacgagtaggggtattatgtagtcgtccaagaatatcgcctgtggtagcagcttcccctattttcttattaataattggtgctactctattgttagcatcttcaacaattgctgtaacatttgcatctgttttgatattaggcgcatccttttctgataatacaggaaagacatgcgaaacgagactattcggtgcaaaatcattagttgttggatcgatgtaaccgataatatcatcgtaagccttacctgtgtaaatggcttgcactaattttacactaccaacagtagcattagcatattggtgggagtgaccggcaacataaaggtcgacagaattatcagggtcaatttggtaaagcttcttaatgatatcaacagcattacctttagtgctgccatctttatccgttgaaacccctgtatgggcaagaactacaattgcattaacaccctttttacgtaaaatttgatcatattttgcaattgtttcagcctcgtctaaaacatcataatctttgtaattatcgtataaggttaaaattggtagggaagtaatttcaatcccaataaagccaatccgagcaactttaccatcactagtatgaatttctttaatcaagtatggttgcattccaaatgggatttgaccatcagatttatttacaacattggcagtaatgatattaatccctgttttcacatgaggataggccatctcagcttcattatattgtttagtaggttcaccaccattaacaatccgcatatactcagctaaaccttcatcaaactcatggtttcccaaagttcctatttcaaaatgcattgcgtctaaagcatgcatagttgattcgtcttgaagaagagcagaatttgctggagaagccccaaccatatctccggcttctacccgaattgaggttcctgtcggattagcgttcttaaaactttcctctgccgcatcaaggttaccagctaggcgtgcaactgttccggcattcgaatacgtcttatctccaatcgtagctgatccagtggtttctaacccaccatgcaggtcattgattcctaaaatctgaactggaatgtcattttgatatttggctaggtcagaccaatcagtagtcgtttgcggagtacttgcttcatccttattagtctggaccattggcgtaacattgctatgggcagtttcaccattaactgttgtcccagtcatatccgcatgaacactattagcttggaaatataatcctaacaatgctgtccctaacaataaacaatattttgaactattattcttcataaaaaactcctctataaatatacaatggacaatagcctaaaagctgttttaattttatcatgaccaaaagttaatttttatagtaatttcgacgcttatgtaagggtatacaacaagactagattaactttttaaattgacttttatatgatatgatcttagaggggaaaaacacctattaaagaaaatgggggggaagtatactgtgagaaaactagcaacaatctttactagcttttttgctggaatatgtttatttattattccaattaaccaacattcagtacttgccagtgatttaccactcaccgttaatatcccagacggtaagaatgcgcaagcgacaagcaaagggattaagattgatactgaagcagatggatctatcactttttcaggaaagactgaagccaatgcaaccattaaaattgtaaagcatggcggaaacaacggtcgctatactgtcgaagccgatgataatggtaattttagtaagagtctaaaacttgctactagtaccaagaagtgtcgtttcgatattactgccactaacggtgatgatgataaaagcgccaaaacaagttttactgttactaatactacttacgtaaaaccagttgttgaaagcgaatcatcttcagaaatatcatctagcagcagtagcgaggaaagttcagcagttaatacaagcagtagttcaactgcaccatcgaataacggtgatatgcgaaccgatcaggccggtatgatcgttggtaatgctcgttcaaaaatctaccatacgcctgatcagcaaggctatcatatgaattcagcaaatgcggtatatttcaactcagaagcagaagcgcaaaccgctggataccgcaaatcattaagataaataatttcaaagtcattattgccctccccacaataatggcttttttatattataagaaaaagctaagaagaatttcctagcttttaaaatgaaggcctacttgactgtggaagataatatggagttaaagagcattaaatgcattttttaggccttcacttaaatatatacgtaaaaagataacatttgcactttttattttaaaaaataaagatctcctatctggtggtacgtaaaaaaagagcagataagagatctttacattaagatttgtgggagaagaaagagagcaagacaggaatcacctgttacttcattttttgacgcgaacctagcctttggaggtcacgcaaacatcaatagtcaccaacagctttgccaagcaatgatagaccattattgtactacgctgtcatcttgttatgaaagcaacttgactcatgtcacagctcccattaagaaagtgattgcagacgaagacagcaactaatggggaaaggagtctatgaacgaacaagtcttcatctcgcaaatcacctcccctataaatatatatacgcaaaaaactaatttttgcactttttatttttaatctttttatctaatttcatcatcgcaaatttaaatactgttttgaacttatatttcatgctggtatgcgacataactacggccatttcttgatcgaacaattaactgatctggaatttgctcctcaagttcagtgatatgactgataattccaatcatccggtggccttcaagttcttgaagggaatgaagagcatcttcaagagcttgctgatcaagggaaccaaatccttcatcgataaagagcgcatcaatcttaattcccccactttgctcttggacaatctggcagagagctaaagcaagagcaagcgaagccataaaactttcaccaccagaaagcgtccgggcacttcgcgttctgccagcattatcatcatatacattaacttcaagcccactccacttggcaccggccccatgactttccgttgctaattcaaactggtagcgactattagttaaccggtctaactgaatattggctgctactaagacatcttgaaaatatgcctgtaatacataccgttctaggctaacgtgattttcggtattcccagtcacaacatctgttaatgtttgtaattcattaatttcttgatcaagttttccagttttttcgactgccttaataatcttttgatccgtttcttctaattgcttatactgagcagttaactgaccaatttcttgctgatattgccgaagttgttcacgctcagcattaagttttgtctgcgttgatgtaatatctggcatgggatgactattgatggccttagtcaaccgctcttgttgggactgattatcctggacttgattctcaaaggtcgttacctgttcacgtaaagatgacaatgttgccacttgttcactagcttcttgccagaaattccatttaagttggacatcatattgggctaaaagattcacaagatatcggtgtaagttatcctgttgcgtcgtttgggtggcaagttcttctttagtctggtcgatccgactatttgtccctgctaattttttggcattttcttgtcgttgttgttgcaatgactcaagctggttattaaaggctttgatctttagttgatcagtttgaattcgcttgtcagcagcttctttagtaggaaattttgctggtaaagaagctgctttttctttcagaatagtctgcttggcgattaaatcctgtttgcagcggttcacactttcgtctattttatctaattcttcttgagagaacttggattcttgttgcaattcttcctcttcttggcgccattctttaacctgttgttctattctatcgaggtcagtcttcatttctgctagtttttgagcgtgactttcgatttgtccctcccaatcactcggtaattcattatcccctaacagttcagctaaattcgcctgccgagtttctacctgtgttgttaagttcgcaatttgggcaacgctttggcgaacttgctcttttaactggtcaagcctactacggttttgttgagctttaacggttgccgctttaacttgcgcttccgttaccaattcaccatcatctgctaagcttgccggatgggggtggtcaagtgatccacaaattgggcaaggggtggccggctttaatttttgagcaagaatggcaatttggtgacgggcaaagcgatcatttaagtcatccaactcaccttgcgatttttgaacgagtttttcagcatccccctgcttttgctctaatttcgcgcaatttttcttttcagataaaagttttgtttctaattgctttaaatcttttccagcagtcgttaatttttcctgaaggccttcttgttttgctatgtaaacttgaacctcacccaagttttcatgctcttttaaattattagtaacaaccgtcaattgctgttgagcgtcttgcaacttcttctgggaagcagcttgctgtttttcctgctgctttaagtttgtttgtagttcatcgacagctgattttagcttatctcgatcatcgaagaatgggagtttattcgtcaagtcggcgacctcagtttgaagctgatcaatttcttcttgctgcttactcgtttgttgtaggtcggtttcaattgtttgctgttgcttttgaaggttgcgcaggtcctcatggagaaatttattgtctaacgttaatttttggagacgtttttcgccatctttccaccgttgatattctgtctggtgttcttggtaccattcaaggacttttacttgctgctttgtttcttggatctctcccgcttgagcttgcagtgtttttccaaccttgataagttcagctaactcctcaatattcttcttcaactcttgctcagtatgaagttgggcatcaagctgatcaactttcttttgctgttgctgctcatcatcgcccaagtgttcaagattagcttttagtcgggataagtaattttttgcttccgctaaccattctttagttgttaattgcgcatcaatcgcggttactgtttcctttaatgattgaagttttgtttcttgagtcgtcaatgacttcttctgttcacgcaaatcattttttagctgcgttgcccactgctcataacgggacgtattaaagaggtcacgtagaagggcttccttagtattgctatctgaatcaagaaactgccgaaactttccttgagggagaaggacaatctgcttaaattgatcacgggtcagattgagcaagtcagtaataaacgtgtctgcctccttgattttagtgattttctggggatgatcgctttcaagcgggtaaataagatcaacggcttgattatgttcaaccaaattgtcgcggcgtccctttaaaacctgtttaggacgacgcataatttgatatttaaggtcttggtgttcaaaggtaaacttcaccattgtttcttgatcagctggtgcgaaatcagaacgcaaagcagcagccgaccgatcacgatcattggttgtttgaccaaaaagcgcataacacattgcatcaaaaatcgtggttttccctgcaccagtattccctgctaccagaaataaggaacgctctgtgaactgcgtaaagtcaatcacttgatgctcatacggtccaaagtaatgtagttcaatcgttaatggacgcatcctattcctcccctttcataatttgagtcaaagccttttctgcccacttcttttggcggtcagttaaattatttcccatcgtttgggaataaaaatccgcaagcaaatcaagaggcgattcctgagcacgctttttactaaggttgagttgaacctgcttggcctgatgtgtccggtggaggctgacaatcttcggataatattcgcgtaacttgtttaacacatcggggattcgttcttggtcggtcaattcaatgtcataaaaatcttctcgtaatgcttcttcaggttttgtagccagttcagcaaaactccctttcaaaaggtgaatatcatgaaccggcgatagcggaacccattcggccttaaaaggtgccgtctcaacaatccaaacgcctttttcttgcttggcttccgatattgaaaacttcattggtgaaccactatacttaactttttcgtcatttaaagcattgcggttatgaaggtgaccaagagcaacataatcaaagggagctaaaacatctgtcgtaactgcactcaatccgccaacctcaatcaaagtttcagaatcagccgttcgcttacttccagccgcaaagaaatgggcgacaaggacatgccttttatcaggagcaaaatgcttttccatctcagttgtaatccgcgccatcgcatcattgacatttttaatcttgtcatcattaaaatagttgcgaacttcttgaatcccaaagaatggcaataagaaaaactgggtatccttgattgtgaccgaagtaaaagcgtcattaatgttagtgtttaagaaaaatgactggtaagcaaaccaatcagtccccgtactcaagcggaccgctgaatcatggttcccactgattgccagtaaaggaaaatgatcagccaggtttaagtcttgcagcatctggtttaaaagcttaaccgctgcttcattgggcacggaccgatcatataaatccccggcaatcactatcgcatcaacttgctggtctttggcaattgcttcaatctgcttaaaggttgctagctgatcatcaagcaagctaaaatcgtttaatgtcttgccaatatgccaatcagccgtatgtaaaaaacgcataatttcctccaaaaagtagtgtctctaatattatatatacgcaaagaatcgttaaatccacttaaaatcttgcattttacagaagtgaggctgggagaaaaattttctctcagcctcaccttttttcacgaataatacgtggaactagcttcttaactaagtggttcaaatttaccaaatgcctcattactatcagcgtttcggcatggaagatagccatattgaccatctgcgcggggctgacgtaaccaaacatagccattatgacgtgaccaggcattataattacggattcgcccaccactctttgctttcgttaaaaaagccatagtaaaaactacagctttttaaaataacccaaataatttcttacgctgctgaatcttcttaatctgatgacgaccaatttcatccccgttaatgatagctcgcgcgttatcttggtattcttgagcaacgtcagcgccaaattcacgcgataatttgtcaaaggcctgccgcatttcgtattttcgtcctggaaggtcatgagcatcagaagcaaaaatatatccttgaccagccgcaatcagatttttactgaatttttcgacttttttaccaaatgtaccaacataggaactagcggtgatttgtgacaggcaccctttttccaacatttgataaagcaagtctggttcagccatgatcttggtatttcgttcagggtgaacaaccactggtgtaattccccgttgttgaaggttaaaaatcatctgattagtgtaatgagggacatcattgtctggaaattccagcatcatatactttccactctcatcagcaaatagaatatcatcattatcaagagcttcaattagctgaccattaattcgcacttcttgtccagaaaagacagttagtggaatattatttttctccagttcttcctgaaattcttttgttcgcgctaaaacatcttgtttatggtttacatagtgtccgttcatatggtgaggggtcaaaagtgcatgggtaaccccgttttctgttgcttcttttgcaagtcgcaatgaaatctccatacttttcgaaccatcatcaatccccggcaaaaggtgacaatgcaaatcaaccattaccattcttctcatcctttttttcacatattaatattttaagtatagcaagttatagcgggattttatagggacttaggacaaaacttcacaaaacctatattatttgaggatgttgagaagggtctccttgttgatgacggcatttgctagctcatttcctgaaagaatagaattagcaagagctgcttttttctgttgcatttcaacaatcttctcttcaattgtgttttgtgcaatcattttataaatcgttacgttattcttttgaccaatacgatgagcccggtcagtcgcctgattttcagctgcaatattccaccacgggtcaaaatgaatgacaacatcagcactcgtaagatttaaccccgttcctcctgctttcagagaaattaagaagacggctggctgatcataggaattaaattcatcaacaaattgtaaacgatcttctttctttgtctttccttcaatcacaaagtacttaattcctgcattagcaagtttttcttttaagattgctaatgccgatgtgaactgcgagaagagtaaaattttatgattatctgccatttcatctttaattaaattcatagttgccttaatttttcccgaaggaccactgtaccccctatctaacaattgaggactgcaacatagttcacgaagacgagtaatttctgccaagactgctaatttattctgctgaaactcttcatcattctgtttttgaatctgtcttatcaatctttgagcccgtgcctgatatagactttcttgtttaccaaccatgggcgttaaaaatacctgttcatttttcatcggtaaatcattaaggacatctttcttcacacgacggagcatgaatggttgtaccaaacgttttaagtcgtcctgagcttgctcatcctgatttttaataatcggtccttcatactgtttgcggaactgctgataagaaccgagaaagccaggcatcaagtagtcaaaaatactccaaagttcgcttaaccggttctcaattggagttccggttaaagcaaaacgctgcttagcattgatcgctttgactgttttagcggcagcagtttagggatttttaatgtattgggcctcatcaataacttcaatattaaagagatgcccttcataaaaatcaatatctcgtttagcggcatcgtaggaagtaataatgatatccctttctgtactttgcgcaaactgtttccgccgttcagctttactaccatcaagaacagttactttaagatctggcgcaaactttttaagctcgttttgccaattatagataactgctgctggggcaacaattaaattctgtccgtttccttgttcacttaatagaacagtaataatctgcagggtcttgcctagtcccatctcatccgccagcagtccaccaaaatgatacttcattaaggttattagccactggacaccatcatattggtagggacgcaatgttgcatgaagatttgccggcaccttaaaatctttctgcggagttttaacatcagtaactagccggcgcaattctgaagtagtacgataattcaatgcttcttggtgggataaaagatcatcaagataaagagcacgatacaccggcaatttaagttcttccgcagtaaaatcacgtgatgagattcccattttgcgcaatgtctcaactaattcagttagcgaaggttcatccatcttcaaggttttcttgcccaattgatagtactgtttatgcggccggaaatctcttagaatttgcttgatttctttagcggttagttgatcatcaccaaaatcaaactttaaaaggccagaatcaacggagataccgacacttaccttagtaaacggctgtttgtataacccattaaatgcaggagtagccttagtaattcctatttcttgcaattcattgacgccagttgctagcaaatttgttgcctcatcaactaacagaactgctctagtctcggtttgattaagcttagtgaaatatttagctagtacctgttcaactctttgcatcaaaaattgcggaaggtcatcaattttcttaattttttgtgtttttccatcaatttcagttgccaagtcacaataaatttgttcgtcatgataatccaataagaaaactactgttggtaatggaggtaaaaactttgataaatcgcgatcttggggcatctcgactgaaaacatcgactgaatcttgggtaacacatagcggtaaaactcagccatagtatcaacaccaaaaacaaggtcactggttactggaaaaacagggtctaacttatcaggggctattcctgtaaaagcagtccaggtatggtcatcaaggtggtaataggctgcctgtccacgaataaggtcagccggaaggtcaacactaacatcaatgtaacgacttggatcgtcatcagcaccatttgctttaattgaaactgccgcttttaatgcacgttcttcacgtttaataggcactttccaccgattataaagtgtattaccagcccttaatatttggtcgacttcatccataataacaccagccagaggaagttcatttttcacggatgcttcgtaataaccatccctcgttaaatcagccgtcgatgatagtttgatgatcaagtctaaccattgtttactatctttatcaaggttttcggggataatttgctgatcaaagaactttcctaaatgaagccgctcaccacgggcaatcccatttgttaaggttgtcaagtttggaaacttatacatatggtctggtacacctgcccggaagtaaaggtattgaccaccatcgtagtattcaccgatattagcagtaatgatcgtctgactatcaggatcgcgatcaagaaaattagctagcatttgccgggccgcttcattagtattctcttcaatattatgttgatcaaggtactttaacaagtaataaagggcaaccatttcagcaatctgttgtccttctcttgtctttataaagtctacctggacgtccacaatcatttctcgattaaaagcaactagcactgaaaagtaatattgtttaaaacgcccagccactgaataattccacttagctccaggaattgtgaaataagcatctgcagctttaattaggatctcagaaatgatttgaacatcgtcaagattagtaaagacatgttcaatcagccgtagcggaaagacttctttacttagaaaactttgcggatcaactggtaaacggtttggcggaaaagctgattgaaaaacctcccctaatgatttttgcggttcaatatttgccgaatcatcatcaatcgcctctaaaaccgcagccatgtgtttacaacgatgattatcctgcgcatagggacaatcgcagtgaacgttggaaaacttcccattatggtatctaccagttactttataagcccgacttccttcgacaattgcagaaaaattatcgtcttcatcgattattaagtttttaactttatcgcgatagtagtaatccctaccccgttcataaattcgttgtgcaaatagattacgccagttactcatgtattgatcctttcaaatattatcttttccttgattatatagactagcatgacgaaaaacaaatttattcgtaccgtttaagtgttgccccaattcctgcaagccaaataacagcgccaaggacaataatcggaagtgaagattcatctccggttcgtggcaaaacattatttcttgtcttatcctcaaaagacttagctaatgaaggctgggtaatcttattctgagctgtctgcccttttattactccgtttggttggacggtatttagcttggtttgcggagtcaccaatatttctggtgctgaggtttgattattatcattaacttctattacctgggtagaaagatcgttcacacgcatattattttcttgggtactatcaaccgtttcttgtacaggcgaagtcactttattagcgtctgcctgtttttctgtcgcggtaacagtaacttgctcgctagttaaaatcaccgatccatcaggaaaaacaattaagacatcttcagtatgctttccgggacgttgaaggtcggtcgcaactttagcatcatctttccacactacctttgttccctgaggcagcttattttcttgttcatcgccaggcaaagtaataacagctttattctgatgatcatcattttcaaccgcaatcgctgtcgtaactttaggagtaggagttactcctggctcaaccgttagtggttcaaggttgattagcgaactatactttaaggtatcagtttgtgccggaagtttctcttttgctgacgctaacttttcttgtgaatttgttttattgagaagtgcttgcaagagtttggtttgcgcattgattgcttgagattgcatcacattgcgcttatctttggcctgagtaagtagttcttcttgaagtgtcagattttgttgagcttgtgacattgcactttcggcatctttaatttgttgagtagcagtaataagcggttgtgaaatctcctctaacttttgaagtaattcttgagcagcaatggatgttttttctgccttttctacagccgactgcattttattatgtaattcggctaatctttgttgaattttgtttagagcttcctcgtgattttcaattaagtcacttatttggtcagttggattatcctcataccatccattagacattactggagaatatgacaaaccataagaatcgatattcgcccacctaatatcatcttttggtttataatatttcccgtctttttgggcttccactaccttatataattcttctagttcttcttttattgttaatcttgcttgctcaagatttctaatattatcttcaaatggtcgacccattttcagataattaatggttctctcgttttcagcaataatctttttcaataaatcaatgtttccttgatagtcattcgcaaggaaatttttatacgcttgattcttagaagttaagtttccttggttataataagtaatataatcaagcattgatctttcataaacgctcaatccaccaccagaaaatgccgtgtatgaaacatcaactggttgcttcaataattcataatattcatcatgagcgttagttaaaacttgttgagcattttctttcatttgctcaagagatgataattgctctttcgtttgtttaacttgattcttattagaatcgacattttgatccgcgtctgccaaattttgattagcaatattaagatcattatttgcggttgctacatcaaaattggctttattaaccgcgtcttgggctgcacagacattctgctgagcttgttggttcgcatcaggcagcgtttgttgaatagtatttttattattttgcactgtatcagctttggcggaattactaatggccgccacccccgttgtaacagccatcaccgtcgcagttgttgctaaactcttctttaattttcttttcttcataaataaaacccacttaattatatttaaaattacaaaaggccagtcagcgaataacgttgattggtcttaataatctttatcattttagcatactttatgatgtacacaaaaagagataatatgttaaatacacattacctctttttcttaggcgacaacatgaacccaatcatgaagtattaataaatactaacgcccgtataaattacctgttttcatttcacataatgggctgccgaagcattgaaactaatctttaatcccattcgttattataattataacaaaccttaaacacaattgatagttttaatcgattaaaactacaccgtattttccagcaccattataaattagtcctccatcatatctctttcgtctaattttttgataaatactgggatcactctttttttgccctatctttacataatgtaacaacaaaggccgtggaataaaatcagcaatttgtaatagattattattactcattttttctacaaaagaaatgccggttaatttattttgtagatatagagccgaataccgataagtaccatggcacattattttataatattgcttacggactctcgaatctagtttttgattattaattgtttttctactttctaaaattatattccctgtagcattatgatcatatataaattttgtataattctccataatagttttcataccaagataataagaagtataggtagattctttaatcctataatttttattaagtgacgttacatcaatgatcgttcccaatacataacaatactcattaataatatcgccaatttggttaaaaactaatttcatatttttccttctagttaataaggaatattctgggatttcatttaagattttttcattatttttaccggcttgcctaatatctgtttcgtggagaattacattaggcgtatggaacaattcctttttaaagttaattagcctattattaatctccaacttatcttcttgattgataatcactccagcaattccatatacattgtgctgatcgcgatttttattccatagttttgtttcatctaaatataaagtatactcattcaccgaattttactcctttcgatctaaagttcatatttttctagatcataatcttcaataactgaaaataatttcataaaatatgtattgtctatttcattttctttaccctctccatctaacaacattgttacagcatcacaaataattgagtaaagcatgtataccgagtttttctcaattttctttaatttacttaccaattctttttcgtcgtcctcatcacgaaaagcaagtaatatgtataaaaggccaaaagctggagtcgtataagcccaatctaatcgatgtaatagttcctttgttgatttcaataattcatgatcatccaaacttaaaataaaatcattcatactatgtggtaaatattttccattaacccctaataaataactagcttctgaacctaatgcctcagataattttttcaaagtttcaatagggattggacgaattcctaattcatattcagaaatatattccctggtaactccaattttcattcctaattctttttgtgtcatatgcttcttttttctttctacataaatattgttaccaggatttcctttttcattaaaattaactctatctaataaggtaggagccttagaattacttctaccagttaaataatttacagatacatcaaaataatttgcaattttttgaagtttttctttattaaaaggaattttttcttgttcataagatgaaattaaagctacggaaacttttatatttcttttttttagttccttactcaactgttgctgtgtcaaatgcttctttcttcttaagaattttaagcgattcataatcataactccttctttttatgatatatagaatttaacacaaaccctttcgatttactttaatttttagtaattgctgaaaatggatgaaaattcagttttttttgaaattttatagcaaaaattttatactttttactgcatatacaaaaacgcacctctttcacaagaagtgcgttttcatttctacctatttgtattattcttcaaatgcctttagttgtttccaaaacattgggagcaagaataactggaggaataatacacaaccagtaaggacacttgtataactaaagaagatcaattctgaaaataagtcggctaagattacgaccgcgatacaaagctggccaaccgttaaccattctcgcttaactttattagctgagaagatcattactaattggattgctactaagactgcctggatcaactgtagtagaaatagtgaatgcattttatatctcctaactaaaaattatcctcgtacattttactacacgttatgaattttttaattacagcttttttacatctatttaacaactgttgaaacctttttcttcgtagtatacttgcgccacaatgtctgtaaataataagcagcataacaaacaattacaaacggaatcgtacaatacaaggcaattcgttgttgtggatcaaaccaaattaagatgcaagaaaggctgctagcaataaatgcaaaccatggaacaaccggataccatggcgtgcgatactttaactcacttaactggtgaccagctgctaaaaagcgccgacgaaaaatgagttcacataaggaaattgcaatccatacaaagacaaccgctaatccagaaacagaaaccaagactaaatagaccgttccagccgcatagatgctggaaagcaaagctaacaccccaccaagcatacttaagagcaatgcgaaaaccggaataccgcgcttattagttttggcgatgacagccggaatcgttccttcattagctaatgaccataacatccgggttgatgcgtataaaccagaattagcggcagagataatcgcggtgaggacaacaaaattcattaaatcggcagcatatggaattccaagttggctaaaaacgtagacaaatgggctttgcgttacccccgccttttgataaggaatcaaagaagccataacaatcatgctcccgacaaagaagatcactaagcgccataaagtagtatgaattgccttagggagggtcttttcaggatgcttcgtttcccccgcggtgatggcgattaattcagtcccagagaaagcaaaattaaccgttagcatcgtcataaataagccgctaaaaccgcctggaaatagcccatccttagtaaagttgttcagcaaaggggcatgatgataaccttgaatcgggataagatcaattactgctaaagctcctaacaaaataaacgcgcagattgcgactactttaatcaccgcaaaccaaaattcgctttccgcaaatgctttgacagtaaaaatgttagataagaggataataatgataaataacaagctccaccaccaaaccggaatctggggaaaccagcgcttcataattaggccagccgcggtaaattcggagcccatcgcaatcgtccaagtcaaccaataaaggatcgcaacggtaaatccagtagcaggcccaatcagatttttggcataaacatgaaaagcccccgtatacggcatcgcaacactcaactcacctaaacatagcatgacggcataaacgattaacgcaccaatcaaataagcaataacggttcccaacggcccagcttgatgaatcgtgtaaccagaactgagaaataggccggtcccgatcaccccaccaagcgcaatcatctggatatgacgagcactcatttcacgagctaaatgcgttttcttagtcatgataggcgcctccttttaagtactcatgcaaggcagcaatatcttgtggcgtagtagtacagcatcccccaacgattatcaatccagccgcgatccattgtggtaagtaatcaactaaaccgcgacgcccatggggatagctccacgtttttgttgtcggatcataagtcgcactcgaattgggataagcaataactggtttctcagtaacttgatggaccgtctcaatggctgccgttacctcttctaatggaatacaattcacgccaactgcaaaaacatttgtatacttcgcaacggttcgagccgccactgctaacggtgtcccatctggtaaatgcgtggaatctttcaaggaaaaactgacatagcatagggtatcgggagctagttctttgacaaggtccaattctgccaacacttcatctaagcgtggctgggtttcaatcgcgatcacatcaacaccaaccgttaaaatatcagttaatcgtggccgatgaaattgttgatattcaattgtactgaggtgataagcaccactatattcactcccgttagcaagataagcgccataaggaccaagcgcgcccgcaacatagttataaatcccggtttcctgctgatattcatcacgtgcttctttagccaagacgactgctcgttggatcaatgaatgggcctcttgttttgaataaccattctttatgaatgccggaacatttgcctggtaggtatcagtaattgctaaccgatcacccgccttaaaatattcctgatgaacttttttaactaatgctggctggttagctaaaacactcgccgtccataatgagttattggtatcagcacctaattgttccaaagccgttgacattgcgccgtcaattagtaatggtttagttaattctgcagtaatctttgtcatctttatccctcctcgtaaataaaaaagcccctcaaaaagaaactagtcttttcaagggacgatcaatacgcggtaccacccaaattcaggaaagttaaaatcctgcactcaaacaaacttattcataagtaataaatttgcagcttgggtaacggtagcaacgccgtgatctgctaattattcaccgatcaatcgctcacgaaccatcttcactaactctagaaatactgcattgcaccagtcacagctctctgttaaatctatcattagttactcattcgatctcagcgaattctcatataaattacgattagtataacgagcgagggcaaattcgtcaagggtgtttttaatgtgattttaatttataaatgaatctgatgtaagaataatatctatactttatagaaagaatgctaatcttgttttaaatagagagtaattctataactgacttgtaaaatctataaacggtatattctgttcacgaaatttagaaagtgaggtaatactacgaatttgtggtctgatataggacagaagtagagaagcagcatttacctttaaaagatcttcttcctcttctgtactcaatccttttttccaaataaactttgccttcatcgtctgtctaataaagaacggcttattactattcatatttatttgattaaaattggaaactgttagagagacaatggagcttttattaaatttactttctatttgaatatcactatggttagtgcttatcatcatattttgagaaatatctaaactacctttatagttaggattttccataaatatggactctactaactcaggatttgtaaactgaatgatacttttgttattttgtgaatccataattaagcaaccttttgttcaattgtcttagtttcattgaatgctgaatttgtatttacagatattagattatgatcttgcgatgaagccattatcaaactatttaactcatcaataatattactgtcatctttatcatcaaaaaaagcagaataaatctcttcatctgatatccagttctttgtatccagagcttcttctttcgtcgtttgtaaaattaagttagaaaaaataaaaagccatttgtgatagacttttgaatatccctaatcaaaagaaaggcaatcacaaatgacctataaacatcttaccacacgtgaattaactctcatagctgatttttggtatcaaggtactaaagcttatcgggctgctaaattacttcagcgtagtcaagaaaccatctatcgtgtttatcgtttcctcaacgacggtaaaaccatcgaccaatatcttcagacttatcagcgacataagcgtcgttgtggccggaagcagacccaactgccaactatcgaagttaactatatccatgcgcaaatcaaggcaggttggactcctgatactattattggtcgtcatgaacacccgattagctgcagtatgcgcaccctttatcgcatgtttgcccgcaatcagtatggcttttccgttaaacagctaccgatgaaaggaaaacgccatcccaatggctatgtggaacatcgtggtaaagctggccaattaggacgcagtatctatcaacgatatcgtgattttccgcattaccaacatgaatttgggcactttgaagctgatacagttcaaggtaaagctcaccgcggagcgataatgacactagtagagcgacaatccaaagtaatgattgtccttaatattcatcataaaacagacgaagcagtgaattgccagcttgatcaatggctcgctaaactgccacgtcactttgttaaatcaattacttttgataacgggaaagaatttgctggatggcgagaaatagccaataagtatgatcttcacacctattttgcggaagtcggtgctcccaatcaacgagggttaaacgaaaataataacggcctcttgcgtcgtgatggtcttagtaaaaagctagattttcgcgacttaccagacgaactagtcactcagctaatgcatcgtcgcaacaatatcccacgaaaatctcttaattatcgtacaccattagaagtattcttgagtcatgtcacagaagaacaactttcaccttttttctaatttaaattgacatttcaggtatgaaatattttatacctttaactaatctataaaaattttctaaaccagctataggttctccattagctgaattatcaagtgtctttttgccaaataaaaaatatgttgcatcctttaagatccaatagtttggattatttttcgccaatctattaaccagctttaacgcagcataattgttatcaatgattaaaagctttaattgctctaattgaatagatgctccaacttcattaataaaaaaattgatacagttaataatatcagatttaaatcccaacaaataattaattaaatcaagtgattgtgtaaagttaggaatatatttttgatcacgaataacttctaacacgtcacgctttgaaataatgctttgggaagtcctagcctttctcgcaagaagtaacaatgtatttaaaattcctacaatatcagaatttgtttgatgtttgcttaaccacttactaataataccacatacataattttctgaatttagagcaggtagaatttttatcttacaccttcttactttatagatgtctttcttatctatctttagcttattaattatttcgttatctgataatttactaatgttacttccaaagtcattaacattagtaaaaaagtttctagctttattatctaattgcgaaaaatatagtaagtacttatccttattatcaggtaagttagtgattacttctgaaatttctgataatttttctttaccgattttaacttgtacagaaatattctgatttattatttcataatcattgtcactctcgacttcaatccctctaaaattattttcatctataaagcaaaatattgaatctatcaatgtgtaatcctgataggcaaatcctcgcgatgcatatataccttccacgatctggtaacgccataatatttctcctttctagaaaataatattttcattagaaattatgtcaacaccgatttaaaattgtcagaaatcaccggtttaaatgctgttttgtatgttgttccgtgtaatctttcatgcgatatgatttaccagaaattttaaatatttctgaatgatgaactaatcgatctagaattgcattggcaatagtaggattagaaaaagtttgtccccatttagatagcggaatattagtagtaacaatgattgactttttttcatatctccttgaaattagctgaaaaaataggttggaccctaaattatcaattggtaaatagccaatttcgtcgattattaaaagcttataacgaagatagttcttgagcataggctcaagacgattctcttgataagctaatttcaacctttcaattagttcatgacaattaacaaaataagtactcaaatggtttttacatgcttcaactcctagtccagtagctaaatgagttttacccaccccggaactgccaataaataaaacattacgtgcattctcaacaaattccattgacattaaattgattattttttctttatcaacagaaggttgaaaattaaaatcaaaatccttaatttccttttggtaagggaagtgtgctgtgtgaattgacatacgagctgagcgctgcttacggtaatttaattctttatcagttaattgtttaagaatttcagctagcgagagttgtttgtctccttcgaggtaatttggtaaatattctctaatagcatttagtttcagtgcttctaagttattttctagttctgtataagctgtcattgatttatcctcttaaattatcaaacatagtaagattacgttgaacctgtttctctaattcttcttcggcaagatcgtgatatacaccgttactgagtacttcttgtagatcgtcatggtgataatttattttctgatccgaaagcaaatgctttcgaagaaggcgaccatcaaatgatacaagaagtagagaatcggttatattgactgtaacttcttttccgatatacttaactggtacagaatatttattacccttgtaagtgatcatggattcattggaaactttgcgagtttgatcccgatcaattactgacagaagcaaattcttgtcaaaaggtgataaatattctttttcttttgtccataaagtgtttagcttctccccagttgcttgactcaattcattattaagctgcacatttaacttgtgaattagctgtgctaagtcatttacattatcaaattcataatcatagactcttaatcgttcaatggttctagctagtgattcgactttacctttggtttgtggtctgaatggtttacatgatttaggtgtgaaaccagcagtgcgtgcaaactccagtaacttctcattccatacaaccttagtaaaggaacttctagcatgatcaacagctgttttcatattgtcgaagacaatttctttaggaactccattcataaattcaaaagctccaacaagactcgagaataaggtatcttgtttccgatcaaagacaaaattaagatactttttcctggaatatccaagaacataaagaaaaattgagaacttaataggagtaccttttcgggtatgtagaacaaaatcctctttccaatcaacttgtgcagattgacctggcgcagtctgaattcttacaactggagttgtttgtttttttactttaatttgatggcaataatcacgcaatatacttataccgccggtataacccatctccttaatgaaataaaaaattgaagtagctgaacaagaattcttaaccttctcatcaataatatttcgatagggatctaatttacttttacgtcgttttcttttgttttcataaccatcgtctttcaaataataatattttctagctgtccttggatcacagcctaattgacgacctaattcagtaaaatttggtttaattttatccatttgatattttctcaactcctgtcgaatatcttgtctcatataaattcctccagatttaatatgaaacaagtataaaaaatgttggaaaaccgacaattttaaatcggtgttttccaacattttataaccggtgtggacaaaattatattatatattcttgatatcaacatctatcctcataagtcgatagtctacctcaagtttactttcattatttaaagataatcggggttaattaaatacacatcgcctaatgatctagttaatgcaacataaaatttattaatacttttaagatcagtaacttttttcttcccttgaataaattcgactgtggacttagttaaaataatacaaacatttttatatgttagtccttttgattttccccatgttattaatttatcatcattcaaagcagaaattactttttttactttattctctgctacaatgtcccatactaaaattttatcgcattgtttcaatctctgttctacatcttctgcaggagtaatctctactttcccgctatttaacgactgtgactcaattgaaattcctaatttattcctaatccaactgcaaacatcaggggtaactcgataactagtttctaaagtttttacgtctacggtaacatatcttttcaagaaaccagccttctttctaagaaattcttcctcaccgattgaaacataatctttctttgcatatggtagccgtcgacgatttgtagtcacaacacatgattgatataaatcgccaactaagactaaattaaaattgcattttgtcattttaattaacaaatttagttccggcttacagatatcttgaaattcatcaattactataaagtcaaaatatttatgcagtctcctcattcctttctcaaagcaacttgtttccataatggcacttattctctgtttagaatataattgatcggttttctcattttgccagaaagatttttgattttttcttgtatacatactaggctcagttttataatctattccttttaatggagctaatcccttttctagaataattgattgttcgaatggctttatgaattccttccataagaaaatgtcgaaagtttcaacttcgaaaaaatcacaattactttttcctgcaattgaattttgatcaagtaattgttctttcaagttccttgcattatcgttagtaaaagtaaggtataaaatccttttatttattaacttatccaacctatgagttataaaatacgtttttcctgctcctgctttagcaagataaattatactattagccattttatcccctctacaatataatctggtattttatattgactatctattcttgcaaatctttcttgcattttaagtgctactttagttttatgatttaacatgtaagaaacatatttatcataagtgtgcccattaactttattttctacattagctttagtactaaatggttcctcgcatattaatgtcttatttttttcgtattctgaaacttcaaatgtataattcagtaggttaaggtctgtatatacgcgaacattttctccattaaattcttttatttcttgcaatcgctcaatttcaccatcattatctgtaaatactaagatcttatttcccacttctttgccaagttttacaaacggttgatagtatctaccattcattgatagcacttcaatatcattttttacatttaacttttttaagaacataggcattaaaatatattctgctgctccttcaactaaaataacttttttagcagttaaaattctcaaaaagtctaaatcatctctcttattgaaatactctaaagtggattcatctaaatcttgaaatttatagatacttttcctgttctcaaagtcctttaaccacaataaattcctaacagataatctagatactatatgagaatcatgagttgtcataattatttgaacatcatcactatttttttcaatgttggctagctgctctctggtactagatgctgttaaatgattttctggttcctcaataacaaccaactttgtctctatagatttatctaaagcaattttagtcttaattaagttttctttaccactaccttcttcttcaattgcaacttgcttatcattctttattcctagtaaagattcaaatcgcaacccatccgtattaacttctaaattatagccattaattttttgatttatttccgaaaaaaggtcattatttttatctcgaaatgtaaatttagcaagtaattgctccttcttatccaatgtataatacatctgtcttgcaaacatattatatggatcaccattaaatcgatcattatcaataaacacactcttcatcggatccattctagccgtatacgttccaccaccaaacagattatgtttaacatgatataaatcataagggattaacaatttttcatcattattcttagttttttgataaagcgtaaactcatcttcataatcgctgttaaactcgtaagaaaatgatattcccatttttccttctagcttttttcctccaattatggtttctccttcaaattttctaagacttggtataagttcatcatcactttccgtttcaaatgttaaagccagttggaatgatggcaactcatctaccgattgagtacctatatcataattcttttgtatttcagcattaatgagttttgctaagtaactcactccgttatattcaaaacttgatcctttcaagattagtctaagagcttgaatcacagttgtttttcctactccattatttccaactaaaatatttttattcctattaaatgttattttttgtaatcccttaaagcttttaaaattgtataagtacaactcattaagatacaatatttatctctccccctatttcgtttactctatcaaactttagccttcttaagttgattaagttttcaaagttatcttaataaacatacgttctaatcctaccatataaaaaaacgacgtccaagctgtttttcgtattaatataacctagcaaattcacacttataaacattgtcatccttatttccaatacttcttcaattctcttgctccttaaaattttattttatataaataattgcaagccatgtacttttatactaattttagattttctaactgtaaaatttcgggtttgttaactccagcatctagaaccaacgtaatataatgatgtttaagaccgtgaacattgttatacgatccaattacctcatacatccccgaaaaaatcttctagatatcataattaaatggatcaattttagctcctgcatgatgatctaccacataatcttcaaccaccacttttaatccttatacttatttccattattcttctcactacttgaagaaaatatagtatcatttgtggcacttttttgtttttctttctctcattcttcttgtttctcaagttctccattgctttgactttattattttccttggttcttcccagattaattactgtaaccgttatttctttatcctcattatcaaaatggtcatattccaattcaaaatgccgattttgatcagtaatcgtcttttcatcattgttatcagcgccttttacacgggctttcagagaagttaggccctcaaccttgacataataagagtcatactcgtcctaagagtagattatgcttcttcctcagaaatgcgaaacctattcctaagagaatagatagaattcccgttgtaaagacctgcaaggcatgaaacaagactccgcgtataaaaaatatggttccaaatattccaagaataacttcttccatatgttatgttatttgtaagcagtcaatacggacttcttactatttaattattggccaccaaattcaaactaactaaaaagaaccgccacgaatgacagttctccctagcccaatttaactggcgatgattcatatttgcgtatcaacattacttgacataggaccaaagtcttaaaagcgccttactatttcaatagttttagtacagacattttaagctttttaaatcagaactatatagctattggcagcctaataacttaaaatgaatagtcgattattacatttttaaggttaatcttcatttttaaggaaatcctttcgctcttctaataatctagataaaacttttatgttattagcactacttatatttagtatagaattaacttccttgataatttgttcgctcattgctttatctaaaccgttaataatagttttcatattttcttctttatgcgaataaaataactcttggagtaaaaaagttagaaggtcattcataatttttttgttatcgatgttgtcaaacggatataaagtcagaaattctttaatgaataaactacgttcttcttcatcaagaataagtagataattagtgagatagttaaatgtcttacgaatataatttttatcaattgctatctgtattacttcttttaattctgctttccattgtttattactaattgagtttttcttaaaactatttactatgtcttctatcctatttaaaattgtacttctagaattctgagctaatgtgaaatagctgtaaaagaagttactatcacttataactttttcatcaattgaagtatctggtacctcagaaaaagctttagcattttcatttgtatttataaaaatataattaagcagtggatgacatggtttatcaaattcatcaataaacgaatcaattttattatctaacaaatcttctttacgttgatatatagttttataggaatttggataaaacatatgaatataactaatgatatagtaatcaattgtatttaataatctaggagactcttgtaaatagggtaatatcattgagtttaaatatcttttaaagtctcttagtgaaagttgttgttttgctaaatataaagcaaatttttttacctcaccaactaaatattcaaggttactttgatctaatacatcgctcaaataatattctgttaaagcagacatagtcattacatacttatcacttaaactagcatagtcaataattgaaacatctatttctttctgaactattttatctagatatccttcttttattccattatcttttaaaatcttattaaccgcactttgatcatagctaaggataaagatcatattttttatatcaaaatagttataaatcattcctaataaagaaatcaatgtatcactatttagcctatctaaattatcaattataattactatctttttacccgacctagtcaaattagtactaagtattcttttataattatttagttcatcaattcccatagtatcaaaaatcttataatcatgctttgtgattaattctactatagctttaattaactttaagtttcttatattatgtggaaatacttcattcggcatttgattaaaaaatgcctcaaaaagttttgaagtagatccatacatccagggattaaattgaaaaagtagatattgtggactatttaatttataaatacaattattaattaaagtagtctttccatgcccccattctccaattactccaatagtaaatctaccattaaagtttatgtccctaatactcttagcaagatcattaacttgaaaacctctatttaaaaaatcatagtttactgcttcttcatctaaaaggaaatgtgaaggtaatttctctttttttaaaatactttcggtcacttcttttatagtaaaaagatttttttcatttttatatagtgtcgaatacaccgttaaaaatacaatcctaatacccaaataaatatagtcgcataataaaatgataaaataatagtagatagccgaataatataaaagaagaagaaaactaaatattgaaaaatttaaaattatataatccattagatttacaaatctatctttcaaaaaagaatacaatctaaatacaacaataaacagaataaaacataatataaagtaatacttatagtcattcactttttttattattttattagaaaattgaataaaaactaaataacttaacaacgttatgatgagattaataattattaatctgcaaaccgaaaacaccttctttttcatgaatatctcctttttttcttaaattattgagctctcacaccactgtacgtatggtttcatatacggtgatttaccgatattctctattctttgtgtgtactagcgaacttctgtgcattattataatatgtctagtttccttaaattagtaattattattttgaatttcttctacagcttctagatatattgtcgaatacgttctcataactattagtctcgtcgttgagcaaacgttgtcattctatcaattaaataatattgaagctacctatacatttttctgttggatttcttcaaatattctagttaccgaaactcctcgattacatttggataggtattctaacgctaacgcttgtttaatccgccgttgtaactctttagtaggtcgcgcataggtgtgttttatacttaacaaaaagcttaagaattttaagcataagtaactacaaactttactttaacttttaattgtctttctagaaattaagtaatgctttgtactacttagtctcgttactcctcgatccatgtacttctaacgcaaatgttacagttatccatataacgtggtaactaagctaggcctgttcagttctttttccaactaatttagatcaatattcatcaataacagtaaaaacagatttccttgcagagctacttttttattcctcacaaaacacccatgagctagaactctactcgtaaggcatttacgaattagccacaatatccatggttcactaatatagtgctagagatatttcattagcaaatcataattaacattgtcgaatcagctatcaactaccttcgctatcacgtctttaacaccacgctgtgggcgaaatccaaaactactatccgaaaaaatagctcaaatatgggcattaacacttgagctatcacttgttggactatttacactcacttatatacttttgattttccacatctatcctcaacaagtagtcagtttgtgtttctattttctacagtcgcactaattctacttctaatataattcatgttgtcggaaacatataagccgattcttcctaagcaagaatattgcctcttgtaccatgttactgctagttttaccagaattagcttcgagtagtattgtactttagcttatttcttatccagctggttccaacctattagctactttctattcatcagattccctttcacagtggatatctacgttctcagctcacggtttcgactactatggttcatagcaaacttccaacgcttggctaatattcatgccatgcggacaaaaatctccaaaactgataatagtctcagttttggagattcacgttattcaaggctagacgaattgatatgggcacaaattatttacagatgcgttggtatagataccacttactatctaatatgtgtctgtgactcttctacctcaactttattatcacttatatacccaatatatggtgaaataaaatctctagctatagttgattttggccctaaaattatcttatcgtattttagttcttccttaaagtaggtatatagaaaaggaaatggaaatgaaccatttgtttctaactcaatttcttttggggaattaatatgaaatcttaattctttttcgtaagaatattcaatattcttaaataggaaagacatatcttcaatagtttgaaataaattattatcagaactagaagaagagtctatttcttcttgtagcttttttagttttttgtttacttttttagcaagagcttctgaatcttttgatgaaggaacacaaatggtattatctatattttcataattaaaataacatacatgaaatagattaattgattgattattaataatattttttagatattccttattataaacaagaaatactcctgttgcattctctgcatataagttccacataggtaaactatctttagcaatagttgcacaagatacgtaattttgtgtgttatgtgtagattcttggtttagaaaattaaaaactactttcccttctaatgggtcattcatttgattaatatttgttaacctcatataaggaatcttagggtcttcttttttattttttataagataatgtattgtgttcaaactagtataatgcccgataataacttgctcaatttcttcttccttaacttttaataattcccttatatcctttaccaattccattattctcgtatgactatttaagattttatttattctttcatttaattcttgatctagctggaatcttgatctaattctcttcaaaattattttacttacttcttctgagtctctattagattcattaaacgatacaattagttccacaagtggctttatgatatcagtatcagcattaataatatattttacaaagttatttaaaaatgtttcatcttgatgaagactatttagaatttctttaaacgaatttaggtcaaaaaaatcaaataaattatgttgatatttttttagtaatacattcaaataataaatatcatcttgtttatctctaaatagtgttttatcaatctcaggaaattctatcttcgagtcttttttagtaatctttaatgtcgtttcatcaagtgttataacagaatctatagaaataatatctgaatctaccaccaaaaggtcgtttaaatttaacaatatctgctccatatcttctaagtcatactcattctgcttcagagttttataaagattatcataaaattttatagaacacccaagagaaataaactgacctttttcaaggtctaattctccattttccatcctacttcttattctataatccccaatatatataggtttttcttcttgatttacaggtacatagcttacattatataaatcatagtacccatagtcattccaattatcatgttctaatataagagaattagaatttaattgttgacttctatcgctaataaccttgatatccatatgtatagtcctttctcctttaacatgtagatcatttattatacgctttcgtagtaagtatttggagttaaccataccagttgacaaaaatcctcaaaactatttttcaatctcccccataaactcacctaacgcggtctgccaatcgacaatctcaaaaccagtatcttctgccttcttcaagctcataactgaatggcgagggcggtaagctttggctggatatgctgaagaatcaacaggagcgacttcaacatctttatcctttaagatctcggtggcgaattcgtaccaggaacaactattctcgttagatagttggtaggtaccgaatggctgattatgatcgactaagtacgtcataaactctgctagggttctagtccacgttgggcggccaaattgatcgttaacgacggtgagctgatcatggtctttggcaagacgaagcattgtgtacacaaaattcttgccgtatttaccaaagacccaggatgtccgaatgatgtagtaattagctaaggtttcttggattactttttcaccggcaagtttagctttaccatattcatttcgtggattagtgggtgcatcaacttcatactcgccttcattggtcccatcaaagacataatcggtactgatgtaaaccatcttagcgccaacttttttagcggcctcggcaacattacgcgtaccatcggcgtttacttgccaattgagatctttggcaacatcttcagcgttatcaacggcggtataagcagcacaatgataaattacttccggctcaagcgcgctaatcttttcatttacaacgacttgatcagtaatatccatttggttcgaatcaaaggcgtcatatgcaaccccgcgttcatccaataaattacgtaattcggaaccgagttgaccattagcaccagtaattaaaatttttgtcatttgttttctccttaattaaagccaattaatgatataatcagtttgacaacagctctcaatatttttccatgtcatccatctgttgtccttaaagtaagagtcgtgcatcccttaaacttcgggaataacacgactctttttatcttttattgaccgtttttcgcatacttcgcttcaactgcggctttttcatctttccaccaatcttggtgttccgtataccaatcaatcgtgtgttgtaaaccggtcttgaaatcagtaaattctggctcccagcctaattctgtccggagcttcgtggcatcaatggcataacgcaaatcatgtctgggacgatccttaacttgatcataggcatctttaggttggcccattaactctaagatcatttccagaacttccttgttattcttttcaccatcggccccgatcaggtaagtttcaccgatcttacccttggtcaaaatatcccaaaccgcccgggaatgatcattagtgtgaatccagtcacgaacattcttgccggatccgtaaagcttgggccgaataccgctcaagatattagtaatctggcgtggaatgaacttttcaatgtgttggtaaggaccataattattggaacaattggaaatcgtcgcccgtaaaccaaatgaccggacccaggcccgtactaacaagtcagagctagcctttgatgaggagtaagggcttgatggccggtatggtgattcaggagtaaacttttctccttttccttcaccatgaccgggtaagtcttcccgcaatggtaaatcgccatagacttcatccgttgaaatatggtggtaacgaacgtcatacttgcgacaagcattgattaaaactgaagtaccaacaatattagtttgaatgaacggggtgggatcaattaaggagttgtcattgtgactttcagccgcatagtgcacaacggcatcagcttggcttaccagcttatcaactaagtctttatcacaaatatccccaacgacaagttcaactttatcctttggcaaaccatcaagattagccggattaccagcataagtcagtttatctaaaaccgtaatgtgttcaacttccgggtgatggttaacaacgtagtgaacaaagttggagccaagatttcggtcgtcgccgtatactttggtaccacgacgaactgggcgacgacatacccgagcactccggcaagtaatgtccagataattaacatcttaatatgtttacgacagagcatcattaaccgatgcaaatcaattgtattattcgctgtttgttgtgaactattcacgacttctactcctcatgtattaattttttagactattttgtaacaagttagtgatccgttgttgctcactggttggcaccacttcaaaggcttgaccgtcttcattttgccctcgcccttgcgcatgatcttgaacgatgtgttcgttcgtatcacgatagctttgcgctaaccgcatcatatcattgaaggtcaaatcggtttgtgagttatcagatactgaccgtaagaatgaccggttaagaaccgtcttatatgaaacggacttcttaagcaaagcagtaattactaaccgttgccgttgttgccgaccatagtcaccatcaggatcgtcataccgcatccgactgaattgaagggccttttttccattcatgtggtaggtctcacccttctcaaagtgatagccttcataatcaaacgtcaatggggacttgacatcaactccaccgacttggttgattgccttttccaaaccacccatgttgactaagacatagtagtcaattgggatattgaagtggtcctggatcgtattaattgattccttgactcccccataggtataagcagcattgatctttgctggtgaatattgcggataacccggtaagttaaccttcatatcccgaggaagactaacaatcgtggtcgtcttcgtctttggattcaaagtcattaccatgatcgtatccgtccgacccttataatcccgaccaagtgccccggtatcagttcctaacaggaggattgacacgggtttcttttgatcaagcaccttttgcgcatcccgcgacttggtagcacccgcgctactatacatatcatcggtcgttgattttaggttgtgccatgccatccccgcaaagaacagggcgacgaggactaatacccctacaactgaccagaagatcttccatccccggtgacgccgatgatgtctgtggtggtgatgatggtgttgttccggttgttgcataccatcatcattattcaagggtcgattattttcgtctgacataaaaaatttctcccatttttgactaacgccgtaattaaaaaaaatccactagtgcaacaagttacattactggaaacctacactaacaatggtaaataacgagttacaaacttttttaatatcagttgtcagtcaatcaaatttataattacttaatacattattaagaatgtaataccgatagtcaaggatgaatttcataactttttcacattttcgtcaaatcatcaagttccttctctctttccttgtgattatatcagccttttaacgggctaattgcgaattctgatcgttaattacctgtttatttcattttagttacaaattcaaatttggttgttttgcctaacaaaaaaagtgcccaggaaactttccttaggcactcaccgttcgttacatatattcattaagcttctcattaaactctatcagctctgacatactggcatctttttccggctcaacgatctgcgtggaaactcggttagcagagtcatccatttgttgtcgcccccagacgctcatggttaggaccatgttacgcaagtcattaccatcgtcagtcaatgaatacttgttttcttcatcgacaactggattaacaattcgcaagttctgcaaggacgttatttcttcgttaagagcaacatctgtcaactctggtagcaattgatgtaattcctcaatggcaaatggccgaaagcctaaccaaaagataatccgtggttgccatcgatcttctaaaacatctagtgtgtattttacgccacactcatctttcttttcagtcataaaaatgctccattctattacttaagctactcctcttcaccacctattataacaagctaatggactaatgtttaattattgtgcatttttgtgctgttttttctctcagaacttatttatcacccgttttacttctttaacaagttcagcgggtgtttcttcgccatataccttcttatgagccttattcagaatatgtaaaactgttcgaataaagagatcaagtgccaacttacgaagtttcgtataaacacaataatcaccaaagtaggttcgttcgaagagctcccttttcaccttccccaggcgatgcatccagtattcaaagagggaaagctggtcattagcaacttcatcagcggcacttacaattcgccgaaaagtgcgctcagaagtagcaacttggacatggtatttgtctcctgctcggccattcataatcatttctaccctcttatcactctctaactcactagcgtcctccatcagatgaaccatgtaataaataacctgttcatttgatgatccacaagttggcactaggcgatggtgaccagcaacatacccccgtgtttgacaaccaaccttagcaaaatgcacttccatttcatactcttgaactactcccacttagctaaacctacggtttaatgcttgaagtgggagattctggaaacatcgcatacttaccctaccgatcctgaacgaaccttcaagcagaggttacgactattaaccaaggctcgtcccgagcctaactttatctatcggatagctaatcctttttgcaagatgacttgtgcagcgttaatatcacgatctaaatgtttaccacagtttggacaatcccactcacgtaccgctaaccattccgatttattcaatcctaaccgatgattattcttcccacaattagcacaaatttggctagtatatgacggattgacctgaataagctttttaccgtaccagtcacacttatattgcaatatatctactaattttgaccagctagcgttagcgattgccctagctaaatggtgattcttcatcattcccttagtattaagtttttccaacacaatgatgtcgtactttttgaccaatttagtagtgaatttttgtagctgatccaaccgttggttggcaatcttttgccgatacttcgccaccataatacgagctttctgataattcttaaaatcgtctaattgccgtggaactaacactttattatgatgatcccaggcgatttcctgctgggcctttaagaaccgacgactacgcaatttctcccaacgatataactttttacggtatttgtcttcaaaatgattgatcggttccttgcatccatctgaaagattaagtaatgacttaagtcctaaatcgccaccaatatatttacttgttttaggaagagtttggttttcgctttccactaaaacagtaatgtaatattgaccagcaacgttcagacgaacagtgacattcttaattttacccattggcaatcgaccagctctaaaatagacgataccgagttttggtaactttatatgatggcaatctaaaactttaatattgccattaacgtactttgaattgtagctctgagaatattttctggatttaaatcgagggaacttattttgacctttaaaaaagcgttgaaaagcatcggctaaattgcgattagcactttgcaaagcagttgattctgcttgtttcaaccaaggatactcaaccttaagttgtttcaacagattattcatcccaaaggcattcacaaatttagcttccggattgttcttgcgccgttcaatttgcatattaagcatttgattccatataaaacgaacacaaccgaaggtttgccagagctgatttcgttgtgctgaatttggatagatgcgcattttaacggcttttagaaccattattttctcccttgactttcaatatatcgttttaaaacttctaaaggcgctccaccagtgctaattaagcaatagctttgtgtccaaaaggctgatttccaaagatactgcttgatttctggaaattgttttttgaccattctggagctagacgatttgtaagcatttaaaaatttagccatttccttatgaggtgttgctctaaacaaaacatgtacgtggtcctgatcatgattccattcttgcaaattaataccgtatgcttgtcccacaactacaaaacgatgtttaagatattcagatatttcatcgttaattacttttcgacgatacttaaccaccattaccaaatggtaattaagtaagtatactgaatgatgatttctatctaattctattgttatcaccacattttatagacatatactaaatatatcatataacaaaagaaaaatcactaacttgctttaagagagcgattcatcccctacttatagaagtattctcgcaaatttatggataaattagattcgcctgtacaaaacgactaagaacatctttcaaccgttcccgaataagcagctgttccccgtcgattgttaagacaaacattcgattttgatcgtaagctgttagcaacaaggtgttatcccactgcaccagatagtttgccacctccccatcaatttttaatttatccagcatggtcatatcgattgttttacgaaccacaattatctcctccaagcaaatcataaaaaagtgcaaattcgttgtaaaacggttcacttttaacttgaatattaagatactgggataaatctaccctgtcaacgtctttttgggacactttcgccctgctttatcgttcgctaagacaatggattttttgataagttaacggtactcaagagctcttgagaatatttttaaaggatgttctcaacaatgaattaccaaaaaatttctgacggtctaacttttctgatgagcgataagcggatcacgattgtccatggagtattaaagagtctcgggatctcaccgcgccgggacgactatgatgattttgtccaagatgcttcgattatctttgcccaggcctacgctgatttcttacaggagacagatgaggtcgaaaacgaacgggacttgatgtgttttgcttaccaacggatgcgctggcgtttactggaccggttacggcggcagcaacttgaaagtttcctctttaattacaccctcgacaatgaggaagatgatcatgactacgacgagacaatggttgaccatacagcgaccgccccatttgctcacctagaaaatagcgactttcttaattacctctaccaccattgtccccgcgttcaacaacggtatttgattgccaaactcaaccaccatttgagtgaccggcagattgcggatgagtaccaggtcagccgggcagccgtttcgcaatggcggcgaggagtgattacccgtgcccaccagattcgtgctaaaatgaaaggagagttttgaggtgagaatgtggaaaaacatgaaattgaccgccaagctaagtggctccatattaagtatgatggcgaagatcgcgatgatgagtgtgttaatgagcttagcatttaccagaacactgatgagtctgagctgcaaatgctggtatcaaatattgattttgataatatcagccatgataatacttttgcactgacaaaagaggacgcaaaggtattgattgactacttgcaaaagtggattaactaaaaaaacaggtctggattgctccaggcctgttttttactcacttacttgatcttttcccgatcaaaactttcacccaacatcttccaataatccatgatcatcgcaaagtcaatcggaccttgaatctcgaggtcaagttgggtaattttttgcaactcattactcaataagacccggaagtcagttagtttaataatcgttgaatggggcgatggtgggactaaactaaggacgtgatccatgaggccttcaatcaaacccgagtagaagtccattaagtcctcacttggcaaggcagttggttctaataaatgctctcgctctttgtcaaaaatcttataccagtgcgacatagagttccagtacgcattgtagaggcgtttgctttccttatcagcgtattctaactgataacgacttaaaactttccactgttctaacaaatcaacatagagtgattcatgagggaaagccgtgtcttcccgggtttccttaataaagtgtgccaaatcatcagtcatctgaaccggtgttttcattttcatttctctcattttccttttatattagtttgttgaatggtgatcggtggttttttagttaatctttgccataaaactgcgcagctgcaatggcccgttgccatccccgatacaagtcagctgccttttgcggatccatttgtggatcaaactggtcgccaatccgtgatagcttccgtaactcatcctggtcttcccagaaatcaacggccaatccagcgagaaaggctgctcccagcgcggttgtctcttccattgctgcccgcttgattggcgtttgtaagatatcggcctggaactgcatcatgaagttgttccgtgaagcgcccccgttaaccgttagtgctgttagtggtaattgggtgtccttgaccatcgtatcgacaacatctttggtctggtaggcaatggcttccaaagttgcacggatgatatgtccccgttcagttccacgggtaaggccaaacattgcgccccgcacttcttgatcccagtacggtgcgcctaatcctgtaaaggcggggacgacataaacgccgccagttgtcttggcatcgacagccatttgttcggactcgcttgccttatcaaacatcttgagaccatcccgcaaccattgaacggcagaaccggccacaaagatacttccttcaagcgcgtaatgagtttgcccgtccaggccatacgcaatcgtcgtcaacaagccgttatccgaaagcgtgggttttagtcccgtattcatgacgatgaaggctccagtcccataggtgttcttgattgaacctttatcataggctgcttgaccaaagagggctgcttgttggtcacctgcaatcccggcaattggaatctgcaccccatagaagtggtagtcgccagtataaccgtaaatggctgaacttggctttactactggcaaaagcgactggggaatatcaagcaggtcaaggatatcttgatcccagtcgagggtatggatattaaaaagcatcgtccggctggcattggtcacatccgttgcgtggacccgccgtcccgataaattccatagtaaccaagtatcgatagtcccaaacatcaagtctccctttgctgctttttcccgggcaccaggaacatggtcaaggatccacttgatcttagtggccgcgaaatacgaatcaatcaccaagccagtcttctggtggatcatatccttataaccatctttaatcaattgttcggcgatgtcgctcgtttgcttcgattgccagacaattgcgttataaatcggcttaccggtatggcgatcccaaataaccgtcgtctcccgttggttagtaatcccaattgccgcaatcttatagggcttgatctgggacttaatcattacatttgaaatcactgattgaacgctatcccaaatctctagaggatcatgttcaacccaccccggctgcgggaagtattggggaaattcctgctgactgatcgcaaccttatttccgtcatggtcaaagataatcgcccgtgagctcgtcgttccctggtcaatcgccatgatatattgttgttcactcaattatattcatcctttcgctgctaattgcgagcagtttctacctatataatgggaagaaacttgatggattttagatcatacaaaaaagccaccgtgcaaagactgaactgcctcccccgatgactctcttgttgttacttgtcgctaaccatcttaccagctacactatagcggtctttgcgcatctcattcaacacgatatgcacccgttcggcaggaacattggcatcctttgaaattgctgctgtaacatcctttacgagagcctttaactgctcatcggtccggccttcaatcaagtcgatatgaactaatggcataatccgtgcctccttctaaattcatttaaaatcttaccataagagcgcttttccggcaattacattaggtcaaaatattaaattattttcgcccttgtaaattttcccggacttcctcagctgcttggcggtcaccagtaaagagaatatgatcgccgtattctagcactgtatccccatgcggatcaattggcttgcggtttctgaagattcgactaatcgtaattttgttaacaaacggtaaagtatgcaattcgcgtccactataccggctgtttaacagtgtagcctcatatagtcccgcctcggtatcggtcaacatccgcaagatcaatggtgattcaatcaaggcccgcaagacactgctttggacattgaaactattaaagatttcaattcctttttcacgaagagcactaacatctttgggatcaagacggggattattttgactagcaatcacccgttttaccccatgttctttggcgatctgagctaaccgcgcggacttatgatcatttaagaatccaacaacgataatgtcacaatcaaagtagccgccttgttcaagggactccgcgtcaagtttaggcatatattctaaatgtttcacctgactattataaatcttgaagttattttcattgtccgtaaccatccgcacgtcataccagttcttatataattgttgtgaaatcgggacagttaaagtattggttccgataaagtttaccttttgtttgattaagtccgccttctcaagtttgtaggttgaattaaatgcaattggcgcaatgatacaaacaataacagcggccaaagtgaaagctgctgattgcgcttgggtaattgcatgcaggttgcgagcaacttccaaggtcggcaaaaccaaggtaatcgtggttgctaccaagaagcttccggcaaacgagttacgaagcttaaaccgacgccgataaattatcatggttggcaacttggcaaggataaagccgatgaccaaaatcgggattagggcaagcgcttggtggttagcaaataagttcttcaagtcgagccggtcgccggtcatgataaagaagaacggaatcaaaaaaccgtagccaatggagttaagccggtcttcagttgtttcacttggctgaagaagtttcatcaccattcctgccaagaaagcaccaagaatgttttccgccccgactgtctcggcaatcgtcactagtgcaaagatcaagaagaaggcaaggcgaacatctagctgggttgttgattttgaaatcttgttaaaccaaacatatggctgcttaaaccgacgtaacaggataaaagccgctaagaaaagtaaaacaattagccatagccgacgagcattacccccattgattgaggcataaaaagtcaacgctaacatcgggaccacttctcctaaaaccgccgttagcaggatcgtctggcccaccggtttttgcaagatatccttttcctttagcgttgcgataaccaccccgagggcaaccgttgaaaagataattgtcgccaagagaacatccttgaataagcccaaacgactaattacgattgcaataatcagcgctgcggcgataataaggccaaatgcctgcgaggccataacgactggtgacttactatcacgctttttcccgggcgttttgcggaacaggtcaaaattgatctccatcccggacaaaaacattaacataataacccccatcgacgacatcatattgagggtccagttggggttaacgatatttaagaaactttttcccagaataatccccgtgataatttcagcaatggcggtcggaattgaagaaactttaaaccgcgccataataataggaataattaacgccgctaacataacgattaacagtgataattgttgcatattttctttctcccttcctattttatacagcaatattatatacttcttaacttgaaattaaaatattctaactaaatcgacttaaatcattgttcgcggtacaattaatatattacacaaaaggagaatttattatctatggggaataaattaactgcatgtacaagtatattaattggaaaggatgctagtatcgacggcacgatcatgatcggtcgaaatgaagatgctaaggctgcctggcccaagcacatggttgttcaccagcgtggcgaaatgcccaaccacttcatctctaaggatacccgtttagagcttgacttgccagaagaaagcgctcgatacacggcgactcccgaatggacagataaagatggtttatttgaagaagatgggattaatgaatacgatgtcgcaatgagcgcaaccgaaagtgcttattcgaatgcccttgttttaggctatgatccgctggttgaaaatgggctaaacgaagaagcaatgatcaccgtggtgctaccatatgtcaaaactgctcgtgaaggggttcaacgccttggtaacttgattgcaaagtacggaactggcgaaacaaacggggtccttttcgccgataatgacgaggcttggtacttcgaaaccggggcaggtcactactgggttgcgcaacggattccagatgattcatacgcggtggtcgccaaccaactggcaattcaagagattgactttaatgattctgccaacttcatgttccatccggggattcaagaattcgttgagaagcatgacttgaaccctgatccatcgacttttaacttccgcaagatctttgggacggctgatcggtcagacgcaatctactctgaaccgcgggtatgggctggtcaccaaatgtttagcccccggcaagcaacggacgagacaccagaatccactgaattgccatttatcatgaagccggaccataagttatcgatttttgatgcccagaactatctcagtaatcactatgagggaaccgaattcgatccccttggtcacggtgaacacgctcataagtaccggccaattagtttagcaaagacccaagagtcacatattttacagatgaaccgaccgggcgctaatattcactggttagcaatgggagtcgctgctgaaagtacctatgtgccattcttcaacggcattactgatacgccagccccttacaagcgtgggaagctgccggcccagctcaactctgcttactggattttcaagcataccagtgtgctagttgacagtcacctgcacgatttccttccattattacgggacgtacaaaaggaacgaaacgccgcggccattaagatgattgccgaaactgatcgtcgccttccaagcctcaaaggagaagcacgagcaattttcttaacgcgacaaagtgacgattatgcgaccgatactttgaacgcatataagaaattaagccttgagctaattacgaagatgactgattattgtgaattaaactttaatacggacgagaatctgtaagacaaaaaagaagcagaggctgggaattaactattaattcttggttctctaacagtaaaatccggactatgattttgattgatggctataatgccctctaagtatacagatgaaatagaaaattcatcttatatactggagggcattttttgtgggtaggaattcaaaatatagtacagaagaaaagctatcgatattaaacgaattaagtcattctagtgttaaagaggttgctagaaagtattcagttaatgacagtaccatttcacattggcaattactttataaataccaagggattgatggattgcgatctactcaccacaattgtagctattcaaaggaatttaagctggctttggttcaacaatatcaggaatcaacagattcccttgaagtattcgcaatcaaacatggattaaaatcaaaaagacaattatcaaattggattatccagtataatgaatcaaaactgaaggcttatacgtcaagaaagcgagattcaattatgctaggacggaaaactacttttgaagaacgattatcgataattgaggaactgattaaacatgatatcaactacaattgggcagtaggtaagtaccatgttagttaccaacaagtctatggttggtatcaaaaatatcgtaaaagtggtaatgacccgcaatcacttcgcgatcggcggggtaaagccaagccgaaggaagcatggacagaagttgatcgactaaaagctgaaaatcgcttactaaagacccaacttcttcgtaaagaaatggaagatacctactcaaaaaaagtaatggaaatacgcaatcgggaggcgaacgattcttcaaacaacaagctatcaaaaaattgagtcaagaacatgactggccaattagtgtcttgtgtcagatcgctggcataactagagatgcttactacaactggcttcatagaaagccaagtaattataaagttgaacaatcagagctacttgaagcaattctagaattagaggaaaaacataagtggacactgggttacttagcgatgacaacgcaactagcctttgaaaataaactaagcttcaaggcgggactaaagcgggtaactaattgtatgagaaatcatggaatcagggctaatatccggaagaagagacataatcgtgttaagcgttatgaagaatatatcaatgataatttactcaatgaacaatttgatcgtcagagtaaaaacgaagtttgggtaaccgatactacagaggttctgtacgggatagatcaggtaaagaaggctcacgtgcatgtggctttggacctgtatggacgttacgctttgagctacaatatctcacccacagaaacagcagtgtcagcaattgaggtatttaaacgtgccttcaaagtggaaccggatgcccatccgctgatccatacggatcgcggatcagcatattgttcaatggcttttaatgactatttagccgatcaaaactgtattcacagcatgtcacacccaggccatccttgggagaactcgccgatggaacgctggtggagtgattttaagctcatttggttagccaaacgttcgcggcctaaaacattgacggaattagaacaatcagtaaagaaagctattaaatatttcaacactcaacgagcttatacatccaaaaacggcttgagcgcagaaaaattccgcgctcaagccgcataaactatttttctatttaaactgtatacttgacaggcactagtgccatcgatcaaaatcatagtccggattttactgttagagaacgaagaattaatagttaattcccagcctcttttttagacaatgcatcgagtattactgtaagtaattaagcaagcattgcataagcgttaagtcattgcaataaacccttgctctctgcattgttataataattaccatgtgataaattttataacttatccacatttatgggataacaggatttagataaatttcaatacataagttaatgtttttttccgtttttaagcccttttgcgaattttgctgtctcttaatgctgataaatgaagttttccatcccattgtttcagaaatgttaaattttgattttgattgtcattaatagaaagtttaagtatttaccagtaatcattggctggcttgtatttatcaattgatatgaaggtcctcttctctatgcaaataaaaacgaggatcaaagagttttacttcttcaaatcctcgtttatcttaattttgatgatgtttttcaactgccgtaactagttcttccaatgattgacttccaaaaataactgggtcatcatcaatcatcgtcgctggaacactcatgatcttcttttctttccgtaattctgggaagtgttgcagatcaatcattgtagcagtaattcccgtgttgagagaagccatccgttgacaagccgcaacaacatcaggacagaaatgacaagttaaggaaacgccaatccgaatcttagtcggcgcaagtttcttaattcgttctaccatttctggtgcaattgtttgtccaggaccggcaacgttgtagacacctagaactaaggagtttaattcgtgaccagttggaatccccgcataatgtaagccagtatcattaccatccgcatcaagcaagcgcaattgtggtaagtactttacgtccgctggcgccggtttagtctccatctgcaggtgcttatcaagtgaagcaaattcttcaacaaagctaactaactgattgctaagctctgtcccattggttaacacttggagtttaatatccttagtcaaacgggcaaagattggctgcaattgttggtcaatctcagctggcaaccagtttccttcatgcgacgtagtgttttcttgttgactaagttcgctcgtctgccccacagtcttagcaggctttttattagtttctgcatgaattgggataccttgcttttccttttgcaaaataatgtatcgttctgcagcagtagaagcaaccgccccatcggatgcagctgtcacgatctgacgaagatttttatggataacatccccagcagcgtaaacgccatcgatgtttgtcttaccattttcatccgtcatgatatagccccgatcatccaaatcaaggatattagctaatgctttcgttgctggttgcgtaccaatataaatgaacatcccaaatgtctggtcaccatcatcgacatggtaaaccgtctcttcgccagtcttattattaaccaaggtagcagtagtaaggtaatcatccccactaacttcctttacctcagtattgtattccacactaactttaggattatccaaggcacgcttagccgtcaatacaggacatgcaaaatgatcgccacgaactaaaacagtaacgtgcttggcaaagcggctcaaatagtcagcttcttcagcggccgcatatccgccaccaacgacaaagacttgaagaccggtaaaaagttcgccatcacaagttgagcaataagcaattccccgtccacggaattcattttcaccgggaaaaccaacttttttagggttagcaccagtcgcaataattacgcttcgggcagtatatttttgaccactcttgccaatcaatgtcttaacttcaccagtaagatcaaacttttcaaccgcatcatgttgaatttcaaccccaaagctagcgacctggctttgcatctggttcatcaattgggtaccgtcgactttttcgacagctggataattataaaccaccgaggtcgttgttacctgaccgccgacagtatctccttctaaaatcaatgtatccagggttgcacgtccagcatataaaccagcagataatcccgctggtccagcaccaacgatgattaaatcatataaatgttgttctgccatttagctcaccaaattaaagcttaccaactagatcaagacttggcttaattgaatcttggcctggcttccagtttgctgggcagacccggtcaccatgttcacgaacaaattgggcagcttggagcgtccgtaagatctcatcagcactccgaccaattcccatgttgttaattgtgtaggattggataataccatcaggatcaatgatgaagactccccggtatgcttgaccagcgtcttcgtcaagaacatcgaacattcgggctaacttaccagctgggtcagcaagcattgaatatttgatcttgccaatcttgtcagaagcctgagcccatgccttgtggacaaattcggtatcctcagaaacagagtaaatctcggcatttgctttcttgaagtcttcgtacttatcttgcaaagcttccaattcagttggacaaacaaatgaaaagtcagctgggtagaagaagaaaacactccacttacctaaaacatccttcttggatacttcggttgtttcaccatcatgataagcatttaccttaaaatcttcaatttcatgtcctacaaagttcatgtatatcctctccttaaattagaatcattcttaactacaactcttagtataacctttttatgctaatttgcaagcaattttagaacaattctaagaaagattaaatttccttgccgaagattttcgccttaatcgcctgtccagttggggttccagccagtccaccaagacctgtttcccgtaaatcaactggcattgatcggcccaccttatcaagtgcagaaatacattcatcggctgggatcatactcgtacaaccagcgagtgccatatcggctgcaatcaatgcgtttccagctccaatcgcatttcgtttaacgcaagggatttctaccaaaccggcaatcgggtcacataccaagcctaacaagttactaagagcaattgccaatgcttgactgctttgttctggactaccacccgctgcttcaacagccgccgcggcagccattgccgatgctgaaccaacttcttcttggcagccacctgtcgcgccagcaattcccgcatgattggcaataattaagcccaacccaccagcagtaaataagaagcgaatcatctgatcttcactaaggcctaatcgtttttctaacataaaaagagcgccaggaagagtcccggatgaaccggcagtcggggttgcgcagatgactcccattgctgcgttaacctcgttagttgcgatcgcattttccacggcagccatcataacatcaccagagagggtctttctttctgcgcgatattttttcagcttaatcgcttcgcctccagttagaccagtttttgaccgaactcccagctcattttcaccttgtttaattgcggctcgcatcgtcagtaagtttgatcgcatccgttgccagacttcttttcgattgctaccggattcatgacattctgcctcaatcactagttcggacaatgctttttgctgaatttctgcagttcgcactaaatctttaacactttgatacatcgctctttctcctaaagacaaattgcagccgggtacttcttttcaaaataagcaatcgtcgctggctgcatcggtttcttaatatcgtaaacataaatatcacaatcatctgcccgtaatacttgccgccgggtaaatggtgctttttcttccaaatcagtattgaccgccagtgcattggccatctgtttactataatcgcgaaagataacaattggtaagggacccgctggtaaaatatcaacaccatcaaggctaatagccctaatttcaattatcccgccaccaatcgaacaaccggcaaccgttaccctcgtcttgtcaccagtcatttgaagaatggctgtgttaggatggtgaatcgggctttcaccctcttcttcaacaaagcgaagatctattcctctttggcgagcaatcattggcgccgatggaactcgcgaatcatctggcgaaaatcctagcaatcccgccgcaattgcatagtctgtgccatggccacgatgcgtctgggcaaaagatccataatagtgaacggttactttaggtggaaccatgccaaaaagcttatttgcgactcgaccaatcttgaccgcccctgcagtatgcgaactagaaggaccaatcattactggtccaataatgtcaaaaacacttttatagttatttttcatgttgttgttcccttaaaaataaaatagaggttgaaataaaaaccatgtttttctcaacctcttcattataattactttttctttttatgaaagccaagaaatgaccagaagccgcgatgaccaccagattttttcttcggtttcttttctgcttttcgatcttctttgtcagctttttcagcgaatgctttttgcttggcgagaattgcttcccgcttttgccgctctttttcagcctcttttcgggctgccattgcctttttagcccgtgctgcccgttgctgagcagcttctttcattaattgtgccgcatctgttccattgtatcaaacattgttgccaccttaatagctgtcttattggctaaggcttgatcagtatttgaagccacttcaatattacgggctgccgtaatctcacgttcccagtattgttgtgtcttaataggtaaaccagcaaactcctggctccgtaagaactgacctgctcgtgataactgcatcttcaacgaatgcttatccgtttgctgaccatttaatgcttttcgcgaattataaatcgcttgatcaacaaggtcgaccattgcttgtggttcattatgtccctctttatgctcttgaaggacatcctcccccattctaatggcttcatcataaagatccttagaacgatcagtcccattaaagtatttatatgtttgccttacacgtacttgatcagctacatctttacttagttgatcaaaaactactttttcgttcattagatttccaccgcccgactttactcgtctattattcttagtatagcagttattgatcgcgaacgaagctaaaatgtcaatttttttagaagattatcgaaaaatttacccgctcgccggtttgagcaaagtgtaattaagctattattagtcttaattttcgtccattattcaaaaaggaggctgagaaaaaactttgttttttcaacagcctctttaatctatacgaacattatttaagatatcgtggaaattaaccacaagactcaagtctaagtccgaacgataatcagcccgtgccgtgctaatcaccgttctatccttagcccaccgccttgtcgagaaggttaattcccactcactccttattaccaactagccttacgaacaccagggatttgacccttgtgtgctagttcacggaacttaatccgtgacattccaaacttacgcatgtaggcatgtggtcggccatcgtaacgatcacggttgtgaagacgaaccgcactagagttacgaggaagtttagataaaccgatgtagtcgcccttcgcctttaattctttgcgcttttcagcgtatttctttactaaagcttcttggtgatgtaatttagcaatctttgacttttttgccattaagtagttctccttttatattaaaaactttatctactatacaattactatttaaaattaaaacatctgcgaactcttttcattttaatattatcgctgatacttacaaaaaatacaaggattttgcattagtttttgacctttcttaaccatttaattttttcgcgtatttacggtattcgtcagcataattatattgattattatattcagttaaaagttcatcatcatgggtataagcccgtcccgtcaccatcatcttcttgtaaaggtcacggtatggcaaatcactcttatcggcaatttgtttttcctgatcgcgactatatccaatatgacggaagctagtttcagctaaaccaatatcgtctacttccaaaattagatagtgggcccgcaaatcacgctggagaggttgccagtggttgaatggctcgccgactgctccgggatttaaaaccatgcgttcatcactcccataccgcaaaaggtcatggtgaacatgggcataaatggcaatatcaactggttcgccagcgacgttaaacaacttatcaaaattttcactagcttgcgtaggaaaaaggacttggcccatattaagccacggcaggttatgggagataccaaagttaagggggcccacgcgtttcgtcacgtgcatcggccaacttgcaatttcatcaaccattccgtcaggggcatgttccgcaacatactgggctaaccgtgcaaagtaaatgtgggaaggacgctccatatccatcatcccgcgagcaccacgaacaactaggtcatcccagtttcctcgtacaattactgttggcttcatttcttgcaaaatctcccaaattggttttacacttgggcctggcatcagtaaatcaccaataaaccaatattcatcaacatgttgcgctatgctatcgcgatacattgcttgcaacgctgttagatttccatgcgtatctgaaaagactgcaatcctctttttcacagatgatttcccctttcttatcttcattaatatattagcaaattttcgaaaaggaatgctaaattaatttgtattttcggaaggattccccatattacaaattattttgttacaatatacttttatgaataaatcattttaggagatgataattaaaatggattcggaagtcgcaagaggaaaatttcctcacggttggcaccgaactttttacaccctctggctcggcgcgttcatcaccgggatgggctactcgatgacgatgccgtttatctcactttttattgcagaattaggaaactttacgcgttttcagctcaacatttactccggactagcatttggggtgaccttcattagtcaagccattgtttcaccgttctggggcagtctagctgatcgcaaaggacgaaaactgatgtgtatgcgtgcatcgggagtaatggcttgtacaatctgtgcaattggatttgcccaaagtgtctggatgattattggcatgcggttccttcaaggagtcttttctggctacattaataacgctactgctttaatggctggggaaacaccgcataataaatcaggctgggtaatgtcagcgatgactactgcgggggtggccggtaacctggttggtcctttgcttggtggtttcctatcaggattgtttgggtaccgaatcccatttttcatcaccggagcactaatgttttgtgtctttctcagtacatggttattgacggtagaacacttcaccccaattaaaaaagaagcgatgaagccaatgaaagagataattcataatttggataatccaccattgatcttcgttatgttcttaaccaccatgattgttacttcttctaccatgtcaattgacccaattatcagtttatatgttcggcaattgatgggcggccatggcaatgttgcctttgtcgccgggattgtcgctgctactccaggattaggtacattgcttgccgcttcaaaggttggtcacacgatggaccggattggaccagaaaaagtattacagattggaattctcacggcctttatcctctttatccccatgaccattactaaatctccatgggccttggcattctggcgcttcttgcttggtttggcaaacgcggcgttaatgcctgctacccaaacggtcttaacccttgacgtcccaaccgaagcatttggccggatctttagttataatcaatctttccaggctgcaggtgcagtgttaggatcaattcttggctcattcatctcggggatttctagttatgaaatggtctttgtcattactggtttgactctcctgcttaactttatcttggttatgttggttagaccaaagaagcagcttacagaataatttaaagaaaagagaaaatcatggttcaaacaaataaattattaaatgaacacgaagtaaataacttattttcccgggttgccccccgctatgacttattaaacaatgtgattagtctaggaacgcagaaaatatggcgacacgaaatctttaaccagcttcaaattaagcctaccgataacgccttagatgtttgctgtggaacgggagacctcgcaattgccctggctaaacggatctctgctggacgagtaaccggacttgattttaataaagaaatgttggaaatcgctaaagaaaagacaaagatgattggcaatcttttcttggtacaaggggatgccatggcgttgccatttgatgacaatagctttgatatcgtcaccatcggctttggcttacgaaacgttccagatgcagataaggcgctcagcgagatttaccgggtcctcaagccaggtgggcaattcgttagcttggaaatgtcgcagccgactaatcccattattagagtcggctggaaagcttactttacggcctttccattgatggcttcattagctggtggacattaccgcgattatcaatatttaaagcaaaccagccaacaattcgtctccgcccatcaacttgcacggatgatgaaggcagtcggatttaaagaagtccattaccaaccattgaactttggcgcagctgcattacattttggcgataaatagaaagggcgcgaggtagaagtcactcatgactatctcgctccctttttaaattattaaaaaagaatattgacaacattaaaaaatgattataatatactgacaagcaatttaataaccgcaatgaaaagatgagtaattgatggtcgccttctccagagaactgcggatgatgggaagcagcgttggctaagtcagtgaagatggtcttggagcgatgaaagttgtgagctatttgtaagcagcttacgggttggtgtacgttataacacttgggtattcccttggagtacttgtagagagtttggctgtgaggtcaagctaaaatagggtggtaacacgctatcgatgtctaatcattacgcgtccctagaactaacaagttagttctaggggctttttttatttcacgaaaggagtcactattatgactgaatttactaagagaactacatcaccatttcgctttgatattgttggcagtttcttacgcccaaaagaattaaaggaagctcgcgctaaatatcaggcgggacaaattacgaaagcagaattaaccgcaattgaggataaagctatcattgacttaattaagaaagaagaagcagccggtttacacgccgttactgatggtgaattccgtcgtagctggtggcacctcgactttatttggggattggagggaattgaacagtcaacttctaatacaggatatgagtttcacgatgaaacaacaagagcggaaacggcaaagttagtcggtaaagtaagcggaaataatcatccctttgttgagcattttaaatttacacgtgaccatgttagtactggcacgcaggttaaacaaacaatcccttcgcctgctcaagccttctttgaatttttgcgcccagaaaacattgctagtgtcaataaatattatccttcatttgatgcttttgcggcagaccttgtaactgcttatcgccaagtaatcgccgacctatatgcagctggatgtaggacactacagttagatgattgcacctggtcagcatatgccgattttgcccaacatcctgaacatatcaaatctgctggttttaatattcaacaacttgagaaattagaagagacgtctgtcgaactaaataatactattatttctgaccaacctcacgatttaactattaatactcatgattgtcgcggcaattaccattcaacatgggccgctactggcggttatggtccagttgctgatccgctttttaccaaggaaaatgtaactgctttttatttagaatatgacactgaacgagctggcggattcgagccacttgaaaaagtacctaatgataagtatgtcgtattaggactagttacatctaaatccggccagcttgaggatcgtgaagtaataattaatcgcattcatgaagcagctaagtttcacccactcgataagctttgtttaagtccacaatgcggtttcgcttcaacagaagaaggcaatatcctgactgaaaaacaacaatgggcaaagattgcactaattaaagatattgctaaagaagtttggggttaaataaggaggaaaaagatatggctcaacaattatcatcaacacaagaactaatcgctaaacttaagcaaaaacactgggtagacctaacccatacttttggcccagctagtccgcgatttccatcattcaagcccgcaaaatttgaaacaattttcactcatgcagatggttttttcgttaaggaatatacatttgctggacaatatggtacacacattgatccgccagttcacttttacaaggatgatgatcgctatgtcgaggatctagaactcaaagatcttgttttaccattagtcatcattgattatcatcaaaaggcagcagccaacccagatgccagcctaacagttgcggatattaaagattgggaaaaacaaaatggaccaattccagcaggatcatttgttgctcttcgtactgattggggaaaacgctggccatcacaagaaaagtttgaaaataaggataaaaatggtcagaatcattatcccggatggtcactagaagccttaaagtatatttatgagacgcgccacgctactgcaaatgggcatgagacttttgatacagacacagcaactaaacagcaaaatggattagttggtgaatactatgtcctgtctcatggtcactaccaggttgaattattggataatttggaccaggtaccaacaactggtgctgtaattaatatttcagttgcaaaacctgaaaaggctccaggatttcccgttcgcgcatatgcaattttcgattaatattagaaaaagcagagttaaatgaaacctttgaataaatttcatttaactctgctttcttttaaatcagcccaattgcaaatgttacgacttgaaccagtgagccaattaataatattttaactgcacatgggaatgtctctttcttaacttgcttagcaaataacatccgtgtttgcttaaccacaaatgggataatcaataaggttaacaagactgtccatggcgtgaaatgaagaaccgcggcgaaaataatagctaaaaatgctaaaacgttcttaatagcaaatgcatatagaccatttttctgccctataaagtgaataactgtatgacggcgattgtcttcatcttcacccgcatcacaaatattatttgctaataataggttggaaatccacaattcatccggtaaagcaacgagaaagacgaccccgatatttgcccaggaccatgtaaattgctggccaacattaataaagacagaaataagggtaatcatgaaccccattgtaaatcccgaggcaaattcaccaactggcaaccctgacaaaggaaatggaccagaagagtaaagaatgccgattgcaaaacaaaagattcccatccatagtaacggaaggccaacacgagtaactagatagattccgattaagccggctactatactaaaggcaagcaagagaccgagaactaaacgcggtgaaatattttcccgcccaataatatttgtatttttcttataatcaacggtatcaatggcatggttataatcattataattatccatcatatcaaccgccatattgaataatagcattgcaatgaaaaacagaactgaatttagtaggtttagggaatgataataatagacactaaggcaaaccccgaggagcatcggtaagatactggcagttttggccttaatttctactaattccaaaaaaacatttaacgacatttagtaaattttcctttcataattccttagttgttcggtacaatatagatggtacaccataacaaaggaattatcgattaatgaaacaacattttttccatacctatccggcgattaataacgctctaggtaaagtaaatcaaacaattaatgaccggattacaattaaaaatacccaactacacgatgccctacaacaaatggcctcaaatggtggtaaataccttcgcccagcattcttccttttatttgcaaatatcaatcatcaaactgccgatgagcaagaaaagctaattaaaattgcctcttcacttgaggttttacacatggctactttgattcatgatgatattattgatgattcacctaagcgtcgtggagctgtcagtgtccaagccgcttttggtaaagatacggctgtctatactggggacttcctttttactattttctttgatctcctcgtagaaacgatgaccgggtcagcctacttgacacgaaatgcccggacgatgcgcaaaattcttactggagaactaggacaaatggataatcgctttgatcttgatcaatcattactcgattattatcgcaatgtaaacggcaaaacggctgccatttttagtcttgccgctgaagaaggagcttattttggtcatgccgatcatcggaccatcaatttagcaaaacggattggccaaaacattgggattagcttccagatattagatgatattcttgattattcaggggatgaacgccttaacaaacctgttttggaggatttagcaactggtgtttactccctcccccttcttttaaccttacaaaatcatcgtcatgaattagaaccgttacttgccaagaaacgccaaatgacgattgaagatatagaaaaagtccaaaagattgttgtcactcatggcggtgttgaacaggcgcaagaaattgctactaagtttacacaaaaagcgcaaaccgaaatcgatgaattagcagataagcatactcgaaagatgttgaagttggtagcaaataagttattgacgagggtaaattaaaacagataagactaagaaaattccagttctcagtcttatctgttttttattcttgaaccaagatctcaacatcccacgaatcaagcatcgtttcaggtgaatcgccagtcaaaaggtctcgataacccttttgaaattctactggtaatggttgtttaccctttcccatattaaggacaaagtaaatatcctgacctgctgaattttggcgttttgttatctccagttctgttggttctttaactaacgcggaaaggtgcacatcatcaacaatatgcattatgatcttacggagactagcatggtcaaggcgactaccaacataccatgctttcccttttgaataggtattctcggttaccgcgggagtcccagcataaaattcactagcgtattcagccaggacatgagctccattaaggcgaattaaatccgctatcaaatatccagttaattcatccccggtcgtcattgttaatttgacatctttattagggaggattgcatcactttcttcaacccacagtcccattacatctttcaatggtccagggtagccaccaggataaatattgtcggattcatttaccattccggacataaaactagtaataaaattaccaccgttagcaacataatccgtaatcttcttgcctaagccacccttaaccatgtaaaggacaggagcaactacgagatcatactgtctaaaatcatcgtcaacggaaattacatcagtcggaatattcagctcataaaattgccgataataatcaagaataattggtacatattttaggtcctgggtaataccatcgacatactcaaaagaccagaaattactccagtcaaagataagggccacccgcgctttagtctgagaatctttaataaccgggcccacttttcttaaatcatgacctaatttcgccacttctttaaatacccgggtatcagtccggttggcgtgactaatcacggcaccatgaaacttttctgatccgcccagtgcctgcttcaactggaaaaattgaacagtatccgcaccatgtgcaactgcctgtaattcagtggctgccatctgtcccggacgctttaatgggctatatggttgccaattaacttgtgatggcgtcgattccatcagcataaacggttggtgttttagggaacgcatcaaatcatataagaatgctggttgataaatcggcgcatcataagccggataactatcatatgatatgatgtcttgcgcactagcccactgctgataatcaatcattttattgggcagactatgaaagttagtagtgactaaagtcgttgggtcatatttttcaatgatttgcttttccatcttaaataaatcaagcatttgggccgattgaaaacgtaaataatcaattgaaagtccggcgacaattgtttccgatccttctggaccccatgcatcaccaagttcattaggcacaacaatctcattccagtcatgaattgtatgactccacacattcatattccatgcatgattaagattatccaaggtttgatagcgcgcctttaaccattgctgaaattctgtttggcattcttcacaataacaattgccaccatattcattattaacatgccaagcaacaatatgcggattatcgccataccttttagcaagctgttcaacaagatttttcgctaagcgccgatagtttttactgcttgggcaaaagttatgccgggcaccaaatacatggcggcgtccttggtagtcgacccgcgcaacatctgggtatttcttaaacatccaagcgggcatcgcggctgttgaagttgcaaggacaatatcaaaatcagcaactgttaattctttgataatcttatcaagcttagtaaaatcgtattttccctcctgcggttcaagcaaagcccatgaaaaaacattgatcgtggcggaatttatatctgcctgtttaaatactttaatatcttcatcccacgtttcttctggccactgttccggattatagtcgccaccatataagaaacgcggcaattctttcttcatcattatctcaccctatttaaattctactgttactaccttatcgccatgcttaataagcttaccgggagtaaaaccagccgttgctttaatattatgcggttgcgcaaagaaagtaattacccaatcttcgtacccgctttgtctaatcaattcacgatcaaaatcaaagagtaactgaccctttttaacgatttgaccgtcattataatgggcattgaagccttcaccacgcatgttcacggtcccgacgccaatatgaacaatcatttctaaccccttgtcagaagtaatgccaaacgcatgccgggtgccaaacgtaaaattaatcttaccgtcaaatggggcgtacaacttatcacttgttggcttaattgcaaagcccttgccggggaacggttgaccatcacgatcgacaacttctttcatggcgactaattctccatctgttggggcataaatcgtttcttctttaagaccagtcgatgatgtcgacgcttcacttgtcagttctccttgtgctaatttatcctttaattcttcaactacttccgcatgaacttcttcactcaatttcaccttaaaaaggaagacaaaaattgataaaacagctaataccagcgggatataaaaggccatactatcaaaagtccgaatatcatgacctgtcatgtcagcagcagttgcgctccccgtcattccggccgcaattgcgatataaccgacaagtccatttgagatcgcccctgttaatttatcaatcattggtcgcacagcaaggacaaccgcctcatttcgttgaccagactttaattggccatattcaattgcatccgttaatgttaaaactgttaccaattgggcaaaattaatgttaaacaagaccaatccaaagtccatcattaaaacattagagcgggcaaaaataaagattaaatatgctaaactcatgcagacttggccaccaatgaataaccatttccgtggaataaatttattcaaaataggataaaggggactagtacagaaaccgataatcgtagcgatgaccccaacaatccagaattcaccaggtttaccaataacaaacttgtaaaggtagaaaaggacaccattagttacaacataggcacatgaataaagtaaatatgccaaacttggccataagatttggtcattgtgaaaaattgctgaaaaaacttcccgaatggttgtcttatcctgggcagacttacggatcacattgtaattttctttcgtcccaacacaaacaaccaaggcacagataacagccaatgccgaaatgatggcagcaaaggcaaaccaaccagctggcccctgccgatgatgacctgtagctaaataagtaaaagtcgttacaatcgggaccacgataatcgttaatccattccagccaagtgttcccgcaaaggcaccaagagcggtataaacgccccgctcttcagaatcttcgcttaaagcgggcaccattccccaatacgaaacgtcagaaaatgagtagaaaatatcaaacgtaacgaaaataataacaaataaaatggcaaaaagaacccagttatattttgctaaaccaaagattccggtaaacaggattaacagcaaaatcgcgctaacgatatttcccattaaaatccatggcttaaattttccccaccgggtcttcgtattatcaacaatatttcctaatagcggatcaattaataattccaaaatccggacagaaacaatcaaaccagtaatcaacccaattagtttattagcaaccgttttacttagtcctgcaaacattccgcttgtgacaaagataataaagtaagtactcattaccccataaaatgcggagtgcccgaggttaccaaagcaaaacgaagcgcgagaaataagctgctttcccgttagcttatggctatgtgtcatatttacaacctccaaactacaacattctgtaatcgcttacaaatatattataattctttaggtaattttagtaaatatttatttaaaaagtaaatccgttactatgaaaggatataaaaaaatagctaatccgtgaatcgctgatacgaatactgattagctacttattttctttaggaaagcttttacgaaaaacaatattggtatttactgtcagatgaacgtgcgggcgctggggatgagttattaaatcttggagaaggttaattgccatccggctaagcgtctcttggttgatattgtaggacgttaacggcggtgaaacatacttagcaacgtcactgttattgatgctaatcacgacagtatcacgtggcacaattacccctgcttcattaaaagcctggagaacaccaacacttagcgtatcagaggcaataataaatgcttccggtaaattatcaccgctttgttcaagaacccgtttaccaagttgataaccgttttttacattaaatgggccatccacatataatggcgcttcttttatcccttgcatccctgtaaattcacgaaaggcgatttcacgggcatcagcttgttggatgttattgagattaaggccttttccgccaatgaaaccgattcgttcatagcctgctttggtaagacgatgaagagcatcctgaatcgttaattcaaggttaggctggacagaatcaaataattgcggcatcggatttatatcaacaaaaacgccatgcggtaagtattgatgaagttcgataagctggtcttgcgttacccggtccgcccccacgccaataaatccttggaacgaatcagccgccgcaattaaatctttgatattactaaagatttcaacttgcgccccagcttcatcgacttctttaataattgcatttcgcaaaaacgtaaaatattcatcttgcagttgttctttaccacttacccgatacaatagagcaagattaggacggattggttgctgctgagagtttttcttgtggttgttccaatagccaagctcgttagccaccgtcatgatcttattgcgggtgcttggactgatcgataaattttggtcattattcaaaaggcgcgaaaccgttgctggtgaatatcctgatttttccgcaatttctttaattgtcgccatcattttcacctcttttagtaatgggtttagtaaatattatacactagtttgaagataggaaggataattcaatctactaatcttattcttaattattttcccttgtttatttcccttaaaatgatcataattaagaggacgagatttattgatgaggagatttacattatgaataaagtttctaagggccttgtactcgctcttgccggtattactgttggaactagtactggacttagcactaccttttttcaatcaaccagtgttgcctatgctgctgagatgacaaaggaaaaaaatgatttagctaatcgttatattgctgattatttaggcaattgtcaacaatatgaacagaatgacaaaacattcaaaggcttttcttcaatcaaggatattacctattcgcgggacaacaagattaaaattgatgttaataatgatatctatcaattatctaaagcccggcgttcacttttgattcaagatttgcaaaatggtgtgtatggcacattagcagacaacgaccttaagaagttatctgaaaaagatattcaaaagggctgcccaactactgtttacttgaatggaaaagtaattggccacactgccaagaatgataaccatcatattatttggaataaataatcgagtaggagataattgattagttcaattatcgacctctcacaccaccgtacgtacggttccgtatacggcggttcgacaacttaatcactttgaattgactggagcgtcttggacatattcataagtccgagttgttccagttttctatttgttagagaatagctcaaggtcttactgtgtgcagttcgccagtagcccttgcgggtactagcgaagacgtatgcatcacgctgggacagccccagcttctgtaagttagttaccttagttttaagcttcttccattgcttccagatatactgtcttattcgggccctcaaccacttgtcaaggcgttgaataaagtcagttagtttcccaattgagtagtactgaagccatccacgcatttttcgctgaatttcttcaaacattcttgtcagagatattccacgattacgtttagttaataacctcaatgctttctttactcgttgttgcgattgttttgctggacgggcgtaggctccattgtggtctacacccaacgaaaagccaagaaactttaaccgtagcgggctaccgactttggttttatctgggttcactttaactttcaatcgcttttcaagaaactgggtaatgcttcgcattactcgttctccggctcgttgacttttaacataaatgttacaatcatccgcatagcgcacaaagtggtgaccacgtctagtcaactctttatccaactcatttagatagatattcgccagtattggtgacaatggccctccttgtggggttcctttttcactcttagcgaaaagcccatggtctaagactccgctagttagaaacttacgaatgagccttagtgtccatgggtcatcaatatattgttgaagatacttaatcatcaagtcatgattaacattatcaaaataggcttttaggtctaagtcgacaactcttcgataaccttgattataaagatctactacttttgcaatagcgtcgtgagccccacggtgagggcggaagccaaaactattatcagagaaaacacgctcaaagataggtgtaagaatttgggccacagcttgttgaaccattcggtccaccactgttggtattccgagttttcttactccaccattaggcttcggaatttctacccgtttgactggtgctggtttatacttgccctcacgcaaactagcaatcaattccgtcttattttctctgagatatggcagaaggtcattgactgtcatatcgtcaatgcctgctgcccctttatttctcttaactcgcaaataagcctgattaaggttattgcggtccaagactaagtcttggatagtgacactcatacctttaccttcaccataatcggtactacgcgcccttgtgtactttcggttttccaaacctatcctcgacaagcggtcagcttgttgttctgttttctgcgattgtcgcacctgattacacctccgatataagttacaagttattgtcgttcagtccttcatctgattactcagactactatgacctcggctgacttctggcttactcaacgctacatcactgcaccgcttgtttctgtggaaattaaacttattcctcttgtcggaaacgtgtaggccagatctccccgggtaaggatattaactttcgtaccatgtcaccggtagctttactgaaagtaacttcgagtagtgttggactttaacttgtcatgcagtcttatccagttagttccagccttatagctacttcttgttcatcggtgcagtactttgccttagacttccttcagattccacctcacagtggacacccttgtcctcagctcatggttccgactactacggcccatagcggactctcaccgcctagctaatacccatgccgggcgcacacaaaataagagatttgggacaaagttggtgttccaaatctcttattttcatttaaagatcgatttctagaataattggcgtatgatcgcggcgttctccactatcgatcatccccgcttctgtaatcttatcagcgagccggtcactgactaaccagtaatcaatccgccagccagagttattttgtttactagtaattacccgttgtgcccaccaggaataaactcccttttcgtcggggtgaaggtgccggaaactatcagtaaagccagcagctaatagttttgagaaatgcgtacgttcttcatcggtaaagccggctgaatgatggttggttgctggatgagctaaatcaatctcttcatgagccacattaaaatcaccactagcaattaccggtttttgttggtcaagttcatgcaggtagtcccggtaacaatcatcccacgtttgccgctcatctaaccttttaagcccattgccggaatttggcgtatatacttctgtaacataaaagtccggaaattcaagggtaatgattcttccttcatcatccattggttctggcgcattaattttaggataagttactttcggctcatattgggctaaatagaggtacatggtcccagcataccctttccgtgctggttcaacggaacttcgccatgccacttcataattggggaataattcttgtaaaaccgtcaaatgcttcttagttggcccattctttgacagcttggtctcttgaatggcaatgacatctggcttcatcactgcaatcttttttaatacttcccgcgtttcccctgcccgtacagaggttccagttagtgctgcattaattgaatcaatgttccacgaaataaatttcacagctatttctcctttttatttcttaatttaaggtcgctttctttgatgaataccccatcggcagttgtcttacccgtttgctttgcaatttcttgataagctgcggtaagcgcttgttgatggtcaacgcccactaatttacaaaagattagcagtgcaatctgtaagtcaccgatgctgtcgataagcttagtctgattttccttattatacgcactagaaagttcgccaagctcttctgccatcttcataaattcgacacgtggatccgcgtggtcaatcccgcgttcatgcgcccactcatcaattttttgaaacagatcctcgtaattcatcacatgtcacctcatcaagtgataattctagtcttaactataaaataaaagaactagctacgcaataagaaaatttcacgcaagccttcttaacagtatttatcaatcaccgctgttataattattgctagggaaaggaagtgaaacaaatggacttaaccaagtatcgaatcgaccctgctaagtttgctttagcttgcgtgcaaagttcacctgatcttaccactgaagataaattaagggtttacaaggaagcatacgaagaagcgcttactttctatcaccaaattcaaacagccgttattaataaaggtcgttcaaaagaagatcgcagccttaaggaaatgggagactttttcgatttaaagaactaaatcaatcaccgaactcactacctatcaaaatctcccatcccaattgatgaaaaatgttttttaaaattaatttactttgactactcactgcaatcatgattgtggtgagttttttaatttaaaacaaaaataaaggtgccctatttggacaccttcaataccggtcttgggacgcttaaggcgctctttattcatctacttagtatcagtgatgaacaagcttaattctaacataaaaaaattccagtgaataccatgacgatagtgagtaaccatacatactgagataactttatgatgcatattagcgagataaatcataaccacccgtcaaacgggtggtttgcacatcggctataagccgataataaaagccggcgtctcaaggcgctggctttcgctttgctcaagccaaaatgctctgactactttgccaccgctttaagcggtgtttatactacctcacttacccttaaaagggtccgaatattccacacttgttagcttatccattgctatatcatgtttctcttgatctcggatatacttctttatcgtggattcatttaatccaactgtactcacatagtagccttcagcccaaaaatgtcggttcccatatttgtattttaagtttgcatgtcgatcaaacatcattaatgcacttttcccttttaagtatcccataaactgcgagacacttagtttcggcggaatacttactaacaagtgcacatgatctggcatcatatgaccttcaattatttctactcccttatatttgcacaacaaacgaatataatctctcaggtctcttcggtattgattgaagatcgctttacgtctatactttggtatgaatacgatgtgatacttacataaccacttcgtatgggctaagctatttaatttattagccatatttatataacctcttttcccttattgactttggcttgaacacctacatcttaaggcaaaagaggccttttttatataatttttatcgcccacccgcatagcaggtggttttttgtttcgtgcactcgctctgctcgcgcactcaactaggtctaaagacattaacaaaaaaggatgccgattaaggcatcctgtttaccggtacggattaagtaacgaactgaatccactttgcatgccggtacttctcatctgatatatatattataacataaataaattatggtacaatactattgcgtgtcgggagtaacgacccaaacttacacgcaaaaaggggtgaattcccctatgaagtttgtacttctcattctgatcgtgccgaacgggctcgttaagcaactgttacactttgtaaaggttgcaatcaaaaaggctctcaaacgcctaatcgaggaactacttggttaaactccatttaattccaaaaggaggtgggcgagatgttatttcagcggtggcgtttatttgctatcgctgtttttattatacttaaaaactgagcagcaattgcagttcaaagcttttctctacaaataaattttaaaacaaaaaaaacccttgatacacaagggttccgcactactagttgtcgcgacgacgttcagcgatacgagtagccttaccagtacgttcacggatttgctaagctgtttcatctgctattcatgaagtattcacagactattcaattagttaatttaaataggtagaaactcattaattagtcatgaagtattcataaactactcacaaaaaaactaccaactacctaccagataattaacggcatctcttaatgaggtgtcgttttattttacgcgtttatatttattttcattataactccaatataattttcgcgctaattctatattaaatttaaaacaaaaaaggatgccgattaaggcatcctgcttaccggtacggtttaagtaatcaactgaaaccattttgcacactggcatagtaatattgattgtgcctaataagcacataaaaaagctaatcaaaaagactattaagcaactatttgcatggttgcgtgtctagcccttgtggctaggcaaatagttatttcagcggcgacattttatttgtcatcgctgtttttattatacgtcaaaaagccctagtgataattacaatttctctaactaccactagggcttgaatattattgtcgttgcgagtaaacaactgaattaagttgagaagcatttaccccgttggcaatatcagaagcaaattgattataaccaataccccaacttgcaaggtaaccatatggatcaacatgtgatccaccaatattttcagttacccagttgtgggtcttaacaccaggagttcctgcaccaccagcatcaagagttagcggaatgccatattgcttagcatagtaccgagcaacattgatgtaagcagtgtagtccttaatgaattgatcacgattataagtccgaccaagctcaatttgtactggactataagggttagcgttcaaagcaccccaagaaacataacccggttcaccaacctcaaagacttgaccaccgtcgccgacaacaaattgggtataagctgattcccaattattgtgaaggtagttagcgttagcagccgcaccagactcagcacctacatcgtgcatgatgatgtaatcgttgattgcagtttggctactaccttgccaatcagctaggtcataggtgtggttgatttgtgatggagtgaaaccagtattctgtacttctgaaagaatcccattctggtccgcatggtaggtaacgccattaaccgttacattagtattcgttactttgagataggttgatgggtcaaagtaatacttgttctcttgccagttaacaagtccgctcattagacggccatctttgccaaccatgtaccagtcaccccattgtgactttacgtactcctgcttattggcttttagataagtgccgggttcaaagtaataatagtttcccatccattgttgaactccagaaagaacctgaccattatcaccaatcatgtaccaatcaccccactgggattgcacatagtcacgcttagtatggagggttccatcttgattaaagaaccaataagaaccttgccattgttgaactccagttagcatcttaccatcttgggttaaataccagcttgttccaggattagccttaggaagttgccgataggaacgacccttttgcactttcccgttgctctcgtaataagtataggtgccattctgcttttgccaaccggtattagcagaagcaacacttgctgaacctaataaaaaagcactagccattgttgctagtgccaagttcttaactttcttgaatgatttatttttcattaggattatcctccttgttagattgattaggaataaaactcttaccactaaagatagtcttgtctgtgttcaacttaatggaactgttagaaatagttgtctttacaccatcaactccagtttcaacagtactggtggtgacttcgccgttgccttccacaaaaccgcataaaccaagaatggttaaaagcgtgttgataatcgccgctacttgatcccagtgaccatatgtaaagccaaaagccatcatgacttgttgaatgagcacaattaacagcgtaataaaagacgctacaactgttttgttaattgtgccgtctggattaaggaacttctttttaattactgttttgagtttcatttataattccctctttccaaatttgtaattcttcgttcatgatcctttaattgctcatcatgacgaataaatttcttatctccttgctccaatcgttcattggctttagcatattgacgattagaaacctccatatttcgattcaacttacttagttcatcataaattgggccgagaatattttgttcgatattatcaattgccgtctttgagcgtttgcccagccaacggaagccagcaataataaagccgatgattgttagaattgccacccaatcctctaacgaataccccagaaaatagcgaactgttacccagtgcatttactcacctccaactattgagcggcgctacttgccgacgtctcagaggtacttgctgaacttgcattagtagctggggccgatgatgctggtgtactatctggtgtcgtagttgatgagcttgctggagtagatggcgaatcagctgatgaagccggcgtatccggcttagcttcttgtaaagctttaacttgtgatgttaaatcagttacttgtgatgttaagttagcaacctgcgtttgcaagtctttatttactgccgacttttgcaacgcatctaatgcagttgcgttgtcttgcgcttgttggcgcaactgattaaaggacgcaatcgtaacatacttactagggtctgcgtctttccccgcttgtccctcagcaatcacacctgtatcggtgccaccaatcatccagtgtttagtcttagggtcaattgttggcgttaatccattgttaccatcaagccccttgctaccaacaccgggaataccttggagtccttgctcgccttgaacgccttgtggtagttgcaaattcaaagtataggtattaggatcgctttgtaatggtactaaagtagctgatggttgagcgtctggtgacagcttggttaccgagccaatcacaatcttcggggtctttccaggatcacccttggcacctttagtcaaagttcccactttttgcataaccgcattccaaaaggcattaattgtcattgatggaatgttagttacatctgataccttcattgagttttcttcaatcgtaaattgagcaaatccttttgagggatagacagcatctttctgcgtgtcgttgctcatcgcccacaattcaacaatatagttgccaggggttaattgtttaacgtcttctgttttaagaatgacattcttatcttgaatatacccggtagccgtagcagcgaagtccttagggtgttctaagtcattgtttaaggtactagcaatcttgaacgttaatgtccgattactaaaatcaggtactttatcatcatcaagcgcagtaaaagtcattactgcatccgtatcaccgaacttccaatctttccaattatcagcaattgttagtgtgcgcatatgtttctcctttctattttgtgcaaaataaaaacgccctatcggacgttctccttctttattctttcccattgaatggaaaaatattctcgtgacaaatcaacaagatcatcaatctcttttgctggcagagatctattcgattccaggttttcaataactttctcaatctgattattaatgtctgttactagataatcatgatcatcatataagtgcattcgtatttgggcttgcagtgcatataactcgctcgaagtctgatttgcttttttaatcgctgcttttgcatcctcagttatgttgtcaaaaactcgatcattgctgtttgactttattgcttcactgaaacgccctactaaaccatcggttgcattgtagacttgatgagtctgaaaacacgctttgacaaacttgctaataagatcacgagtttcattgttccactctaatgtaacttcatttgtcttttcgagatttaacatttttgtagtctccctttgcgttctattgcttaaatgtgcaattaaaatattcgtcatagatgcaataagacctgctaccagacctgttccaattacgttccacataattaatccaccttttaattgatgaattaattatacaattactctgcatactttttgccagtaaattctttatattgttcctttgtaattgccccgtctttaactgcccagcgaatatcagcatactgttgagctagcattttgattatctcaatcatttttatcactcttttctaactgattgactttttgcgtcaattggaagacttgttgtgttaaagcattgattaatttagctgatccgtctggttcacttgctggaacgttgtatagctttcggtattcatcattactaatgccatgccaggtattatttgctggatcataagtaggctcattcaatccatctggtggtacagtaggcgttgcattggcaatcactgttccgggcttaatcttggctaaaccagttaggtgatagctatcgtcatattcataaactgtttgcggcttattgatggattcattatccgccaattcatatgcttctaagttaatgttgtctttacgtcccacaaagaggttattcttgttatatacatagattgttgccatattgctcacccctatctgtcaaatgcaataattacaagactaagtcgttcaatttcgtggcgcttgcctttaagactgatattgagcttcttactatcaatatcaagacgtggtaaagcatacccttcaaagtgatacatctgtgcaattgccacatcagcgttatcaacggtccatggaagatagatttgtgattcattaaagtcttggtcattgtcgaccttaacatcaccacgtcctagaattaggttcacattctgcataatatggaacttagagagagcaaagtcatttccgttgttagcacgtgacagacaaccacctaaggtataatcacgagtccaagcggaatcggttctcaatacattagctaaccgtccagtaatcgaattaagctggctagttaaaccattgaacttgttatcagtatagttgaatagcgcttggcgagctggtccttgcaagttgtcaatctcagtaactccgtggaacttgttctcaccagtaaaattattgttcccaccaaaagttgccacttggttagccgagattgcagctaataatgcttgaactgctgaacgggcaacatctgctgctccctctgttcctgaaagcattgctttaagctgattaacccagttagcaacttcttgttcaactccagccatgctttgacttacatatccattgaatattttagaatctccataggtcatatagtcagcaccagctagcgtagtaaaggcaacattaatcgttgaaataacttgattgttactgtccttaatacggaaataggcttgctgataatcaccaagtgcttgatagaacgctcccggaattgtaaagtcaagcgtaccaacagatggatcaattactttgtaagtggcaccagaaatttttaaccgcccatcatggtcaacacccacaaggtcaatcgacttgccttgcatattcattggcaggtgattaggaccttgtacaataacaaatggcacaactcgcccgttatcgccttgatgaccattcattgctggcattttaaccgtagtatcggctgaaactgtggtatcaaggataatccgattattgcggtctttagcttcaattaaatcagccattatcattctcctttcaatatcttattaatataaccaattaacgtgtttaatttgttttcaatcagataccagttgtaattaacggtatctttgtaatgagcatcagtcgccaaactgtcaacacgtagcaatcgcaataggctagttttagcacccgtttcagggtcacataaccagttgctattacataagctaatcagctcgttaacttctcgctctaagttgaagaaacttaataatacatagttgcgaagcggacgagtaagcgcattgtcgggagcgattaacgttgcctgaacctgcttactatccgttcccataaggttgtgcatttggctataaagttcattaatcttgttgagcgtccggttaatcccgttactcacattggtaccaatcccaaataaatctgctaaacggtcaagcctcaactcatcaactgttttaacaactggtggttgaggcttattttctggcttatcagttttaggtggattatcgtgaggagggtcaatatgtggtggtggactcggttgaactgttccacctgccatttgcttaaacttctctgctagccgttgagcaatagctcgcatcgttgctttcgttgggtgtactcctgtattaccgtcacccagtgtttgattagcattttcgtaggtaattaatggatctgggcgccagtcgtaatattcaagcccttcttgtttggcaacgtcaattaacatgtcgtctaactgattctggttccagaaagcattgttgacatcataaagggtcttgcttccttgtcgaaagtcctcagtcggcaattccaacaagattttaatgttagggttcttacgctttaacgcctcaaacccattaaccgcattctgcttaacagttgctaaggcttcgggccagctgaagttattaactccataacttactagcgcatagtcgaaccctgatacgtcagtcttattgaccatcgccgtaaagccatttgaactattgtcatacttagttccgccaatcgctacattggctacctgccagcctaagtgttgaccaatcaattcagggatccgttgattggctgaaacattttcttttccgtcccaaccagcaaaaattgaatcgccaaacgcaactagtttggtcatgttaccacctcgttattgattgttcggttcagtattttggttttcctttttgatagctgtatcagcggcgagcttctgcttagcaatggtaattaagtccttcattgataattgcataaagtccttgctttctggtaaatcatctggtttaacccgaattgaagcattgacaaattcagtactatcagcactttcattatgcaaaccaacttgcgcataaagacacttgccagtattagtatcaaattggtagttaaatgagcttaattgtgtttcattcatggtattttcctcctaaatttttgtactaaaaaggcccacagcttacttattagcttgtgggtcttgttttgtttccggttcagtagtttgtgtttgactatctgttttcttgtcgtcttccttagacaacttggttttcaagtcttcaatttgtttccttaattggtcattttcatttgatagttcaactgcttgtgctttgaaacttgctcgatcgatttcggcattagaaagacgtgctgctaattctcgggcggtttgtactaataaatcattgttattcatgttgtaatttctcctttaattctttaatttcttctttttgtgtttgcacttgtttatcaatttcttggaatgcggcgatgaggtatgataattcaacactcggctcacgatattttccggtttggtcgatgaattctcttgggaccgagtaatgcgatacatcgttaacatcatcaataatgaaactagcttgtgggtcgtagacacccttagctacattccgcttatactcataaaggtattgatcatcttgacggatcttatctagcgctagactagtatcaagctttttgatattcgtcttctttgatagggtcgaataagtgagccatccttgtgctcggcaataatcgttgaagtaaacatacttcatgaagcgagcaccagaattaacatggaagttctcgccgttgttatcaccggtattaaattcaacagtattagaattatcaagacgggtaaagccagtataagttccattattagtattattttggaaaaataacgttggcttaatatttactccgccatcaactacttgcatatgcatattacctttagcagcaaagttaatttcctgattattcagactaatagcgggtaccattgaataccatagttggctagctgttgtcccacccgagttaaagtggtcaaaagcattgatatataaatgacgatcggcactagaagtatcatacccaatgctatattgaggaacttctttaccatatgagctatccatgaagtctataccatcaaaattaaatcgagttgtagggttattaaccgcattctcttctgtctgaacataaaaatggtcatcatcagatgataatcttacatgtccgttactcaacgatatcttgtcggtattaagtgttccagtattaatcttatcggcactcaaactagcaattgccgcactcggaataaaagcacgaccggaaaatacgactgacgaagcatcaaggtatagcttatttgactgaattaacgtattaccagccgttaaattaatctgactgagcaggtcaccgctcttgacccgcaggttgatgtcgtcacgaagctgggtgatctcactctcggttgcaccctgcgaccatgcggaccatttacttccgtcgtactggcggctgtaatgaatgttgtcccggtcagacacggcgtactggacgattcgactgtcatagccgggttcaacctgcacgtaccaccaatagtcacccggtggcagattagatccgcctttgacgaaaatcttctgctgtaacacggcggtgttgaggtcaatgctgtcagtactcttccacgtcgcctcgtctttcaaagcgttgaagtcgctggcactaacctttgactggatcacgttcgacagttgcgtaatctgtgatgaggtgtcgttcttgaagttcgtcacattcgattgcagtccgtcaattgaagcggtgagtgattgtacctgtgtcacagtggcgttgtacttcgcatcgaggttcgtgatgctctcattgatcgtacccgctgtctgagtgatcagtgattgtactgtactagttgtagcatagccttttccatcaacaatgttattcacatctgtactagttacttttgactttatttggtccgccatgacatctaaacgagaactaatttgttgagctgtgcccttgatattatcaacatcagtttgctttgccataagactgatgagcttactgttttcatcaatggcagttgtgtttttgctaattgcagtaatggtatcatcgggattagctaaccatgtaccaatataatttccaacaacagcaaagggtaaagctacataaatatttcccttgttaccaacgcagccccataaataaaagtcagggtgattaatatttctatgaccagaaaatttataagcttgccattcggtagtgagactttgatctgtataacctccaccgccccataattcagtatgcattttatctccagcattatctgctttggcataaactacccatgttactagatcatcgttatatggaccatctaaaaaagtagtaagttgtccgccgtctacaccagcgcctccaagaatagcaattctaccatcaagatatttgtccgatgtaacagtaactgaatagcctttattccatccgtcaaatgtgtctgaatggtggagaagattacgagtaccaatcttcattccattaactttatccctcaatgtctgatattcagcggatgaaactttttggctgatttgatcagccattgtcttttgttcggcgctgacttggttaacagttcctttaacactatcaacttcggacttatcggctttatttagcagcatatccttagtttgctgttgttcagtgcttaacgctgtttgcttagattttaagtcgcctgtaataccagaatacttactatctaagttgttaagtgtcacattaagactagccaattgattatcttgaccagttaaagtgtcatgcaaccccttagcgtcaagctgaatgttttggatattcttttgtgcatcgctaagtaataattgcagattgtctgctttctgcgtgaccttatcaatattacccttttcgtcagtcaattcactcgtatgttcagcagcagtctgctctaccttgcttaaacgtccatcctgatccttgaacgtttgctcatacttgctggcagttaacagcagattagatatgtttttctctgcatctgtcattgacgcttgtaacttatcagcagaggttaacaatgaggcaatgttaccttgattgtccttgatgttctggcgtaagcctttgatatcagcttgaatctgattgacatttccctgtgcagaagcaaaatcagcctcaaactgtccttgtttctgcttaatcagagtgatgtcatggccttgttcagcagcacttttagcataagtgtcaaggtcagttccaacctcatttaattgcttttcgactttatccatcgagtcacttgtcgatttaagttcggcttgaactgcttgaacggcggattcattggcggattttgcttgattgacaccagcctgtacctcagcaatagttgattcgatttgcgcaacatcactagccgcattagctttcaattgctgaatttccgccgtagcactatccattgcggactttgcttcaaccaccgctgaactctgtgcaacgatcgcatcactattgaccttacttgcagcaatagcggactcagcaaatttcacagccttatcggcttgttgtcgagctttttcaagtcctggtaattgattttttatttcatctgcaacggtatggtctaacagctcgctgacctcagcttgctgtttcggttttagtaattcccacattcgttctgcatctggccgacgaaagataattcctttaggcgaaataactgtattaaagtcatttcccattgtggaataaccaaaacctttaccaccgccaagaactgtatcttgaccaatgccaacccaacctttgctatcagtatttacgtcaacattggtgtaggtattccgctctttacgggtaattggttgcttatttagtttctcagttagatcaatatttagtccattaatataaccgtcagtatccccaactgttattgaattatcgccatcctgatcaatcattttgtaaaagctaatattttttacatcatctttatctaagctagcaaatcccttaacagtgttaaccagtccaacatagtagccaccttgacgtaagttagaatagatactttgaatttcgttaatgttacctacatcttcaatgtttataaatacatagcttccttctacaaatccttgattagatagattttgtaaaagatttaatacgtcacttgctcctgagtaattaactagagcatgaattttagcattagctttttccgccaatccaaccaacttttcagtatcaatctgattggccctgattaatacaactgaacttttattaaggtcattactattagctgttgttagtatcttgatcggtatttggcttttcaatgttttctccaaatgttctcacctcctgtctcgtccaagtctgctttgaccatcctggattgattatctgtgtaggacgattagcagcattattgaatgattgttcataatcaagaatagatttttcaacactattcaaagtaattgtagtattatttgatgatcttctatgcgaataccaagtaaaaccaacaattggtaacttagacttatagtttcgttgtttgatttcaaaatgaacaatatcgccagggataggtcgttcattattcatcatcgtgcaagtaatagacatatctgggttaggatgaaattgtttcagtgcataatctctcatctgatctttatcttgaatggaatcattagtaatatcatcaggagcaaagaataatccccaacgatcaatgctttcctggtcctttacaataaatggctggaaatagtactgagttgtatctgtttcagtagttgtggttgcatcagttccgtcatcctcatcagatgcaccttgtgagacaactgctgccatttggtcgtttctcgcgtaccatgaaggtgggtagtagctaacaggttcaatcttgcagctttctccaggttcaggttcataaatcattgtatttgcgtctagcattaaacaaatatgatgggtaccaccatggggaccataaaacccaacatcccctgtttgtggtgttgatacttggtgaaaactaggttccattgcaatagtttgagcaggaactctaattccaaagtcttgataaacttgacttacaaaagatgaacagtccattcccgaccatggatttccgccacgggttccaccagctccaccatatacataaggaacgcctaaatacttttttgcatcattgataactgcttgtgcacctttaccacttgtaattgttccgttaggtaatcctgtatccgtagtcgatgtatcttgttgtgtataagtggctcctacacatcgtgcttcattaataattgaattagaatcaatgtcaatttgaatgtcagaaacattattcaagtagtctagacgatggccacgatctttatagaactcatcatgcgaataaacggtaatatgtttggccatcgggaaaattactgcgtcagtccaggtttcagttattttagaaattcctgttttaagagaaacggcatcaagtgctacaggttggggatcaaattgacctttgatttcccaagtgaaatttagccagttattaccatttgtattgttggcatcaccaatgtagtacttcattatttgctcgggtccgattggcgttaaactagtattttcatcatctttattatcttgatttgtttgattaggagcattgctatcaggtgatgctttgtgacctatatcgccccaatcggtattaccatcaacactctttgatcgagataattcagtatagatttgagaacaagtaacttgaattgccgaagacccttgactaggcgcatcacttacctgtttaataacaaaaatctcaccatgatcatatacccaagactgattagttagcatactgtatgcttctgatccgtcatcataagcagtaaaggtaagggtatagtcaccattaaccgcgtaagtccactctacttgatcgaacaataccgcttttagtgctgcacgcttaccatgaatatcttcaatgattaacttatcgccattcataagcatcaccaacctaatacaaataaataaacggaaagctaaatgttatatcaacacttgagcattccgttatttgaaagttattattaccacgttcaagggtaatcgtgccaaaatctgtatcattgttaatattgttattatcaacataacaattaacaccatcataagtaattactcctgattgagatttggtaatttctaatgacgaattatttgttgtatttgttatcttacacttactacctgagaatcttatcagaactttcatatcatggtgttggtaataaggatcaatagcaacatcgctaggattataaactgtgaaattcattgaattaaagtggtaatctcctgggttatttcctaagtagttcattccatacccagttccatctccattaaaatccttcaccgtatcagagcgaaaaatactgaaccaatatccagacggattttcaaaggggattgtaaaagtggctacgtttgctccaggactaatcggtgcaacatcagcggtcatcggataggcgaaatacactttagccatattaatagaatggcgaatccttatcaattgtcgactaccaaaaagtaaattatagagcttatgcttagctaactgtaaatcctcatagtccataaagtttaatgagaacttttcattcattgttcgtttgtcatacgcctctgatataaattgttgaccatcaactgcagctaattgttggtagttattaactacttgtgggctagaacctgaatcatccattcctaggtatgataatccagtgattttatcagttagttttatttcgggctggttaccaaccttaacgtaaatttctggttcactcacttattaccatctccttaaaacgaatttaatttcattgacagtctttgtgcttgcaaaatatcttgacgcttggggtcgaatttaccctgactatgaattgcagcaacttgttgagttcctaaattgattaatgattgtatgtccttatgtaactgatctaatttcgattctaacgacctgaaattatctttatcgatagattggtcgtctcgtgttgtctgaacgctaggttcttcacctctaaaacgtgcaataacctcaccaagtaattgataagcacgagaccttttattaatatctgtcggaataacatattctggcttattctgttccgcaatccgaatgaattgttcagtatcaattcgaccaccattcgcatatccatgaccttggccaagaaaagaaagactatctccataacgtttacgagcatagttcagtcccgcaagcaagttatcaaatccattccaaatatttccatggcccggaagtttattagcagcgaatgttcctggcttaacttgcattaatcccatcgcatgaccgtcagctaaaccatcagttccacccattgctttagggttaccgccagattccgtctgaatttgacgaagtaccttacctacaagactgcctgataaatgcaacattgctaatgcctttactacgtatggccgccaacgttccacaccagaaccaccaggatcagctaattcttcaaattgtttcttaatccattttcctgcttgtttagcaatgtaaatgggtacattaacaaccaaatcactagcatacttaattggtgttgaaatgtgcacgaagcgcttaaatacctcatttagcgcttctattgggtgttcaataaccttatcaataaactctccggcattatcaagcttatcagtaagtccgctaaaaaagtcacctactccattagcataacgaggcaagttaaaagcttttgccaactggtgagaagcttctccgttaagaatagaaattccttttggtaagaatgctaagaaattacgcttattaggaaacattccaatttgaccattaggaagacgatacatttcacgaaagtgttcacccggaccatcatttactagtgcaagtgaagaccttttagtgccatcaggatttccagcagtcccagtcgcatagctcggaactgagattgaccagtcaccactaattttgctagcaccaattttatcaaggatccagttcaaaccattcttaatatcattcattaaggtattaaatggttttagaacaccattagctaaatcagccattgctcgcatggcgttcttcttaccagttgcaattgcatccccaatctgagacatatgatcttgccacgatttaagcatccgtcctaggctaccaccagtaaggtcattcaaacgatcgtacatatccttaaaaatttgatgattattttttcgcatatctttagctgtttgactggtatcttgtcctaaccgatcccagtggccactcactaagtcatgccaagatcttgtatgatcttgaataacccgatacatagattggaatgttttagggtgctgccgatacatatttcgaacaattctagaagttgaattatttaaattgttataccaacgattaatattattcacacctgaacgagcgcttgtttctatgttcttccaaccacgtgatgccgactttcgaacattattccaatactgttgattttgtttttcatcttggcgttgttcacgttgtcgattacgccaataagacttccaattcttggccaaactattagtaaagttatgccagttcttttctgcctgcttattagccttagcttgctcacgattggattgttcctggctcttgctgatctgtttgaatgtatttttgaaaaaacttcctacttttttcaatccactctttgcaaacttagcaatcccattaataaattttctgaattgtttattagtgtcatataaatgctttaattcaattattaatgcagcaatagcagaaataactaaaataattacattacttttcatagcaagattaagcattttttgatttagggcggcaatctttgcagcactagacaatcctttgtaaacagcaattccttttcccaaagtcatataaaaagctgttactaatcttgcagtcttagtaaatgcaaaagaggcaatcattgttttagaaaaaactttaactgctgtttgatgcttactcataaaagcaatagttttagataataaacttaacactccggctaatgctttacttatactattagcataacgttgcatagatttatcagacgtaacttgaactaaagcatctttagcagatttactcatcttaaaggacgacttttgaacatcccctgatagttttgaaaagcgcgatttaagatacatggacattcccatgtaacttgtcatcgcttcagattgtccagtcttatatttctttcccaaatagtccatggccttgacaaaatcatcagcagttaatttgccttgctgggaaagttcttgtaactgtttcatcgattttccagttgctttttgaattgcttctccaaacatcggaaaacgattgatcataacattcatatcttcctgactcgctttaccaccagcaacaatctttgcatactgctcacctgcttctgcaatctgagcattcgtcatatgcatggttgaacctaaacgcacaaagtcattagtccactgtttagcatgtttaacattgctatccacatggtaaaaactttgagccattttattgattgtttctgcagagtatattgagtgctgagaaagatcattaataaaattaattagttgtctgccatcctggggtgcctcggttgtcaaagacttccatacagtacgcattgtatcttgttctttattatattcgcgacccgcttcaattaagccatgcatattgcttgtcatagccataatcgcattagatgcaagattagatacaaaaacacctgcgaatgatgtttttaatgtttcccttaacgatttagtttcacgatttgttaattcttctgcattttttatgccaagaattttgtttctagcagatgcaaagaaaccagatcctaaagtgtctttacgaattagtgaagcatgcaagtcgtcagttctagttttcaattcagaaatttgcgattttgtttttccaattgacgcactagtttcatctaacctcactttttgttttctgtatgcttcactattctttccttgtgttttagcaagctgatctaactctttcttttgaaggtcgtactgcttagaaagagtttttaatccaatacttaagcccttaatttcaacgtcatttgctttaagctctttaccattcgcacgcaaattatttgcatatgctcgtgaagactcctgggctcttcgaaaactagtttgtaattcagctaaacccgaagtttgatactttaatgtactattagcccgattaacttgtacctcatacgaagctaattgtttactagcttgagagatatctttatctaatttcagccatgtttctaattgatccttattagataagttcaagccttcctgacgactttttaattcagaaatcttagccttttgaagttcaattacttcatttaatccagaaatacgcgctttagcagcttcagcatattggccagaattttttaacgcagtttcattagctttccaagcattcgtggccgcactaattgaactccggaacgcagataaacttttagtcgcagcaattgtatcaactgatatccgcgtcgccatttcattttcaactttcaatttatccacctcccattaacattgctaacttcttatgggcatcccccgtattcattggtcgatcttccctagatttagcactcagtattttcagcagttcttcatattcttggcagtcaacttgtgatggtgccattccgccttgaaacattagctgcttttttagatagttacgatcttcaatttcctgtttcagtgaatctattgatcggaggatttctccccttatccttttgggccctttttcttattattaaccgtcttttgatatgtatcttctggtacacctttaatacgattgcagacataacttacataactcccaagttgctgataatcgacacggtctttgatcatatcaacttgtttatcactcagttttaagacatcttgaagaaagacaaagatctttttattaacttctcgttctttctttagggtagcaatcatggcttcactactgtctagatttttctctgatttactaagttcagcatccaaagaaagtaatgtaatcatcatttcatctgctttatcgaccgctcctactgttgcatgaatattaattggtttgccaaggccgatttgctttgtattaattttaaccgtcatatttacctccattcagccgcccatttctgtactgtttatttcaacggcgacttatcttcacttaaacagttggcttatttacatcagactgatttgtatttgcaaaactaccagttccagttgcttgaatatagcttgccattggattatctccagaatagccaccgaacacttctttcaacattgtttcaaagccttgccatgctgaatcgccagtattataggctttgaaagattgttgagagccttctttgtttaagaagacattattagggattgggttcagactctgataggtaaacgcaacattgctatcagtttcattcttgttatttgttccatgattacgcgtaggaagcgtcatttcaccatttgcaaaggcgtcaaagaaccaattcccgtcaaagtcatgggatgcaataagaagcgcaacatgcggtttcttattagaaagaacacgaccaccgttaatatccgtataacctaccattttacttccatcttcatatggcatatccaacatagttaatgcaacttgtggtgttggcaccccgtgattaattcgcttaactttattgttagcatattgttgttgccctgcttcttctaggccggtgatattagcagtagtagcaccatcgccatcaccgtcccaaagagcaattccttttggccctaatccgcctttttcgggatcagtaattaaaacacctttgtcatctgtaattccagccataacaaagtcgatccctttaatagacattcctgccattttctcacactccttttattactaaatctttggcaaaataaaagaccttggtactttgaccagtatcaggatctttcacatgcgcttttgattgttcaaccgtccatttgtcatgaacgaatttctttgctaattctatttccaagtttgttacatcttctccgctcaatgcttttcgataaaaaagctgcacctcaacgccaattgtccatcccttaaaggtggcatttgcataataagtaggctcattaagccattcagttattaaacaaattgttttggcttgatttccgataatttctttaggaatcgattctcgatatacttcatcaattaacgaaaatttattctttatcaataactctgcttgttgtgaaggagatttcatttttgctgacctcgatagacttttgcttgagcctcgaatacctcatctttggcatcacgcctcgtattatcaataaagtggtctccacgcatctttactgttccatcgtttaagaatctagcaatacgtgcatgattaatgccgctatcttttggcccttcaaacccaaccagagaatttccgttatccacatcccccatatctttattttcaaagataatcgaatcagctaagtgtttaaccttccctgtcttccgtcccggctggtagtgcttctcttgcgttacttccttcaactttgaaacaaggacttctgcaccagcggcagtcatctttttcttagtttcatgatcaggaacagcaattttttctgcttttcttccaaattcttctagcgaagctgcaaagtccactttaaccaaccttctttccagtatcctttagtgtaattaagtcatatcttattggtgaatggctttcatcacgggagatcgtaacaatattatagatagtattatcatcatctatttgagcttgaagatcatcttcaacatgatattgggaacgaacagcaatcacaatcgttccttcaagtttagtaccaagtaattgatactgttgagtttggcttcgctggtaaaaagcacaatgtaactgctgtcgagtgataaaactttcgtgtgatccttcaattgactcatcactaatggtttctgtcttgccaaatttaactttatgattcagccggctgatcggaagtttcattcttgtcactctcctcatcgtacgaattccttaatcctcgtaattgaccaatgatactattaactgttaaatcaatgggataagtttgagtatcagataaggctaaacgattttgataataagttcctgctaatgacataacagcaatatcaactaacgacactactcgcgaatcatcataaaagccattaacatcttcaccaatcgcattatggataaatgacgttgccgctttgacgtatgaatttagtaattggtcatcgctatcgtcatcaagatagagcatttcacgtactcgtggtaccagcttatcgaggctgggtgtttcatcactcatgatgatcactcactttcaattaggcagtcttaccagaagcttctggagtggttgcttgctggttggcaacagccttgaatgaagcagtagcccaagcaccatcatcaattacttcaacgtcaaaccggtcaataacccgcactttgtaaagatcatgttcaaatgcgccagcaccaatattggttgaaagcaatgacatatgctcacgatcataaagcgtaattccttgcttcaagtcaccaaagtaaagcgggtgagtgccagccgctacgtcaggtaaccatttgtcagcaactacggtgatagtcttaccatctaaacggtacacatctggttgggttacgtcacgttgaagcatataacgtccttgagcgtccttaaccttagaaaggacattataaccggattgattagtaacgaaacttgaactggacataatcgccggatctaacgtgttattttctagatctttgatatcatcaaagcttgcgatagtaggcttcttagctggcttacccattgcttcgataatcttagcattacgagtaacagttaccttctttgctacccagtttgacaaccaagcaaggatgttttcgacagtatcctttaaaagactgttagtaacagtttgaattgctgcgtatcgatgaatagcatacttaataagtgttaattctggatcgtccatatctggaatagtagctgtttcatcatctaaatcggtcattggtgtaatgtcacttagtttttcatatgtccgtgtaccggtagttgtagtaacagattcaacatttaccaagttttgtaacgtggcaaattgacgaacgagttgatgaatagcgtattgaatatcgtccggaatagttaggccaccattacccgtgccagtcttaccagaagtaaccatgtccttgaattcacgaacaaattggtctttaatatccatttcttttttgtttaaaggcttcttgtcttcagacttcatagccttaactttttgagcgcgtgcttcgtcaagctgatccttaatagcatctcgttgaattttagcgttatcacgttgttcctttaattcagcaaacttgtctttagtgaaattgtcatcaagaacagcagcatttaacttgttgtttaaatcagatacttcttgacccttggcaatccaagcatcatttaattcattaattcccattaatttcatctcctagtaaaattgccaacttctgatctttaagactaggagttggcttttctttgttatttatcggtgtttccacttcgtttttagacttggcatctcgtgctttagccagaacagttttgatttttgcgatagcagtagaattaagaatgggttggttgctaacagcattaaccacttggggagttttagaaccagccgaaatattatcagcaaagcccttgtcaactgcatcttgagcagtcatccaagtttcattagccattaactgtaagatatcgtcacgatccattcccgtcttagcttcataagcgttaacaatagactggtccataacatctaacatcttagaatcatgcgcaaagtcatccgcattccccatagaaatagtagaggctttatgaatcatcatttgactggtaggactcatgttgatttcatcccctgccatcgcaataacagaagcagcagaagcagctaatccttgaatattaactactaccttacctgaataagctttaagcatggtatagatttcggaagcagcaaagacgctacccccaccgctagcaatatcaacttcaatatcctcatcgctattattaagtacatcttctacttgattagggctaacacaatcatatccaagccaatcatagatatcggcatcatcattgctgacaataacgcccttaacgttaatcttggtcatcattatcacctccttccgttgattgcttatcatcagaagaaaccatttgaacgggctgaacttgtacctttggttgttctttttcaggcatatcatctggtaggtatccgacttgttgcaataaccaagctgcttgattagcaccaagtgtcccgttcttctgtaagttagcaattgtagaagcgtactcatcgcctaatgggtcaattgcagaccgcaaatccaaagtgatattagcattaagcttattattaagttctcccgtaattgctttagcatatcgagaaagtgacttaacataggcattacccatcatttgaattgatgattgctgatcaccttgaccattaataatactgtcagagacaccataaactttagcgatttgagcgccagtccaattaacttgattaagtaactgggcaacattgcttttaacttctagcggcgtatattcttccaagtcatcgagaacgatcggcccattcttggagtcagacgtttgcttcataaatttccttgaacgagaagccttgtccttatcactgagcaatcctccgtgtttaatcgataaaatacccggagcaagaatagaacgtcccagagcgcttaatgtgagcttgttagactgatctttaatttgaagttcatttgctaatgcagataaaggactaatcccagtcttaccgccattctgcgatagcaaacgaacgtggattaaatcggactgcggaactgcttccataactcctatttctggttcatcaaaattaatgttgtagattaatccagaaccatcttctaataaaaaaggagtaacttgagacggtctcaaatactcccatgtcatatcggttccgttttgattgcgccaacgataagcgaagcattccccacctaacagcaattgagcaaacatcgattgccaaaacgaatgtgcgttactcgtttgtgttggggtgttaagaattccttgtgcccgaggcgcgtctgctttaagttttccatttgctaaatcagcgcttaactgaaaaacaattgaataaatgtcagagttcttcaaagcagtccgagcgtctacatacttatctgaattatcaggatttaagaagtgcaaaatatcagtatcatctgtaaccgataatcccggactaaccttttgattaaatagcggcaatagctttcacctcctttctattgaaggctagctatcttctccgatagataaccaataatgaccaagctaaccgcaatactaaaaatgcctgctgtaaagctcagcagaaaagatccccagatagcgaatgtaaccgcactgaggaaacaaattacgtcaaaataacgccaaataaatttaaaaatattagttatcaagtaaaccactgtccttattttcaaaccatgctttaacctgctctgccgtcattcgatcgacttgctggctcttatcattagcaatcccaaagtcttcaaagtgatacataccttgatagagtgcgtcaatgattgcatcgaccacatcaatctttagtgtggccttggccttatcgacctgaataccgatcttatcctcgtaaatctcggcattaatcagagccttttccatgatcttgtcgtctaatcggctaacattgccttcaacaaagatcttttgtaaaaattttgtggggtcctttaactcgctagtccgctgtcgaattgattccaacggaaaatcagtatttaaatccatctgtttgatcgccgtcgtagcaccccaagcatcgtagccgaagaagataaccttaagatggttttcatcaacataatttaatagccaattgtaaacttgttcgtcattgattaatccttgtgggtgacttgtaactgtacagtacccttcatctgctaattgacgataattaatcccatcttgtttttctttagcctcgattgaccctgctttattccaagggataaaactatgttgctcaacgtgccacttttgcttacctttttcatcttgatagggataaacaaatgcaatggctgtattatcactaaacatcgaatagtcaaacccgatatatacttctcgaccacgaatatcgaagcgcggaataatcgctctttcaatatcatcaagtttcaagaagctatctgctgactgctgcatccaaatattcattgatttattttggaagcctaacatattaccagttagcatattgttatctctttcagtttgcagatctaaaacaaaccgatcacgttttcctggcatatccatcaacgggttagatttagaccaggtttccggcttaaatacttcattttcatcatcttgacaccagttcaagacaagataagcgtccccttggcgcaaataatcagcttccattagattttgaactcgtttttcatcattatggaatggtactgatggattatcataagcagttgaaatttgaataaattgtttattagtaacatccagttgtccggaagtaatcttcgagattttactattatctcctacttcaggatcagcaaattcatcaccgattgcagttttgaaatggaaagaatcatattgacccgacttgtaagttaccgctaataatcgacttccagttttactcatcacaatttgatccgactgtgacgaaagtgtcttaggattaattcctaactctaaaactaattgaccaaatggtggaacttccatgaggtacaaaagcatctgcttgatataccccatcagtttactagtttgtttatagttaatagaactaactaagaaatcttgacctgcttcattaattgcctcaatcaaaaagctatagatggttacaattgacattaggtatgttttaccgttatgccgggcaacagataaaattgctcgagtgaatcgtttatctcctttactatcacgccaacctactagcatggccaaaacaaattgctgccaccccattaatttaactggtttacgagttttaatttctggacaaactgaagcaaatttcaaaatattttgaacttcgcttgtatcgtaatgataagggaaatctttagcgttttgacgctgcaagtctcgtaaatgtctaaaacatgctaacttaatttgatacccagtaatgtatttaccatccaaaacatcaaaacaatatttagtaccagcgtcctgatatttctcttttatattgctaaagtcagtagcctggtatgcaccaaggacatcatgagtttgggttaaatcaattttcattttctcacttcctttttactactatgcagagtataataaatatagaaataaatgaggtgttattaatgccaactaaacagacccaatataataaaaaatgggtagatacccacaagcaacgagcaaagtatttaagcgatcgctctagatctcgttcatttattcgtaatcaagcaactttagaagacatcgaagaattcactaagctcttagcaaaacggaaagaagaattacaatgacctatgatattaaagcaatcaagaaaaatgcagaacatttaggaaatgcttatttcgatgataaagataagcttcttttaatcaaccactctacactgttaaagcataatcaatatgaagtcatcaaatacgaggacattatgtattgctatgtggatgaaagtgatggtgtacaaacaactaatcactcattaggatatgctacgctgggcgcaatggttggtggcttttttggtgcaatggttggtgctgctgccgggaaacaacaacggaaggttattactggaatacaagttcaagtaatgacgactgatcaaaaggaacactatattgattgtgtaaagcttccagatgccaagttaaatgatattcattattctactgggcaagccgttggaagtaaggttgaagaaatcattcaaaataatttgtagcaaaaaagcagtaatccaacgactactgctttttattgttactgaaaaattcttgaatactcttagcggtcgatccttcttctttcttactttgaacagttttaaatagttctgctcgtgatttcggcgaaagtcctaattgaatgccaattgtattaagcatttgagtagcatcttttaacctgccaactgcaggattctttttccaaccaacaaaatccttgccaattacttttcccgtttgaacatcctgcaaagaacgatatattttttgctgtgctccttctttttgtaagttatcataagcatttcgatattcttggtattgaacgcaatattgttcaacaagcatcgagtcaattcgttgaactctattagttgcctctaaaaagggcactacttttcgccaacatgtctttgcaattggtgttaaatatttaggtggactatatgataaatgaccgttattttgctgatagaatgcgtgttttaccatcatctttcacctcttttgctacgattttgtatcctaataaattgcttttgacccccctaagtaaaaatttgaaaattactgtgcatcacaaggaaattgttctgtgtgctgctctcctcacctgaccgtaccgggggggatgttttatttttggtgcatcaatagaacgattttagaaatttctgatatttctggaacatttttcatttccattccttgaccagttccataatatccttgctcccattttgtttttaagcggtggcatttattacagatggtagctaagttgctactactagccatcagcttatgatcaaacgcaataggaatgatatgatcaactgttttactatttgatgtaagcttaccgatagccttgcaatactggcataggtaatggtcatggtttaatactgattgtcttaaatcaacccactgcttacttcgatagaacctgtactgttcacttctattatcattacgattacgagtaacagtgttgtaatgatggttatattgtttctctttatgctgatactgttcactatgtttacgtgcccatcgctgtctattggcaaggtactctgcttcatgttcaaagtgcttagggcaataatgattagggaactgaaccattgcatgacagttaggttgtctacatcttctataccttggcattggtagcatcccctttctagtcttatgtatgaaagcaaaataaaagacggtagctattgctatcgccttaattgttattcaacttatcatcaatcatcttacgtaattctttgaggtcgtcctcattagcaatctctcttacaaacttcttagcatgtgagcgataaagatagacacgctgtttatctttattcttctcgttccacttcttgttagctttgcgccgtgcctcacttaattctgccatctgtatcacctactttactaaccaagtagcaatacaaattaggatagcaagcactgatagaacgattgagatattatcttttgtttctcttttcataacagacacgattagaacatgatataatttatatacacctaaacaagggctttgttggaacccttgctggtgttagattacttaaataagaacgtcaagattgatattataaagcttgcaatgctgagataaaatttaatatcttctcggcgttctttttgtaatctcttacgtctatctgttctaatcatcatccctcccttcacttattataatacacctatataggtacaatatcaagtgaattgagaaatattcttatttatttttgtgtactttaaaagccggcaagctttgacctgtcggctttttcttttgtattttattcatgtgtcgttcggctctgcacagcatttgatattcctgcctgctagcaactaagccaaaccgtttagtctgaaacatttttcctccaaaatcataaccacccgtcaaacgggtggtttgcacatcggctataagccgataataaaagccggcgtctcaaggcgctggctttcgctttgctcaagccaaaatgctctgactactttgccaccgctttaagcggtgtttatactacctcacttacccttaaaagggtccgaatattccacacttgttagcttatccattgctatatcatgtttctcttgatctcggatatacttctttatcgtggattcatttaatccaactgtactcacatagtagccttcagcccaaaaatgtcggttcccatatttgtattttaagtttgcatgtcgatcaaacatcattaatgcacttttcccttttaagtatcccataaactgcgagacacttagtttcggcggaatacttactaacaagtgcacatgatctggcatcatatgaccttcaattatttctactcccttatatttgcacaacaaacgaatataatctctcaggtctcttcggtattgattgaagatcgctttacgtctatactttggtatgaatacgatgtgatacttacataaccacttcgtatgggctaagctatttaatttattagccatatttatataacctcttttcccttattgactttggcttgaacacctacatcttaaggcaaaagaggccttttttatataatttttatcgcccacccgcatagcaggtggttttttgtttcgtgcactcgctctgctcgcgcactcaactaggtctaaagacattaataaaaaaagtcagtgttgaactgacttagagttatttaataatgttaagtgtcaataccgatccaactagaattatccaagtgtaaaataacattgttcctaaaattttaagaaagttttccattctcatttatttctcctaaacttgttataccaattatttcgtcaaactctttatctaatttcctacaaatggaactatcaacatcaatcattttatctgtgttaatagccgttacacgcttaacgtggcttcctcgtacaaaataatactgacttttgccaaaactagaatctgtttgagcgttatttatgttcttcgatataaaaaatcctacttcattagccggagttgtaaatttaacaagtaattcatcatatatgtaatttcctattttatctttatcagtgcccataaacttaggaacaatcgcaacacttcttcttggaaataatccatgacttgaccaataatcttttctaactcttgcattatcattagagtgatactttaatattatggaataatcataaactacattattagaaatattttcgatactaataaatctgtaattctcagctgacctacttccaagaatttcatttatattaactgccgttcgaccattgccccaaaacaacactcttgttttcaacaccggcttaggtgtatatgtaagcgaaaatctaggccttgattcttcgatatgaacagctcttgtaatgttttcttgtctcccttgttgccatataacagcaacaaaagcaagaattgttccaatacttccagcccaatcagcgacagaccccacatcagttgttgcccactttacaaatgaatcaaacccatgcaaagcaaaataaacaacacttataataactaggacagcaaatagtgtataaattacttgctggtattttttacataacctttttattttattcatatatatcacccaattaaatataatacaaaagcctagctataatagctagacttcgtttgggtgatatatctagtttaacgtcattgcggacaatgctgatggacggaatcgaaccgtaccattagggtgtttagccctacctttatcagcataatacagagaatgatatcgactagatcgttttttattacttaagaattaagcaatctctgcattacatcacggcttagaaaaaaaaatactatgcaattacgaaagaggagctttcatctcctatcatagttaaatttgccgtgataaagccgagaggtggattcaaaccacacttttgtcacacgagaccttgtgtgcccatcttggatctcagcaagcagtgcgactcgtaaagcactgcaattgcgaatattgggaactgcccccacaagtattggactactccaggatacttggcatctaatttgcatattcgcataaaggactgacactctattaaggttttattttgagaaattcgcacacactcgtattataaacactccacctaagaatcaatcatcactgtagtattagaaaacatatagaaggtgagtgccagtcttaaacataaatcatgatttactgggtatcaacgtttccatagctaataccctacgtggattatggtcatctgccaccatcgcgtcggcttggttaccggattccacacttcctacgcttaacaagagatccctattgtgagtatagtaatgagtcttgaaaatacgtagagcagttaaaggcttgctcgggcacgttatttgaaaagtaaagtcgttttcgtaatcattcgacaataccataataaggctgtttttcttgaaaatcacgccaaagtaccgccattttaccgccaaaacaccgccactttacttttcaactaaaacattagtaggaattatcctcgctgcttcccacaatgcttctttctgcatacggttaaaagtacgctcagagatattcagtttcattcttacctctgttattgagcgatgatgatgaacaaagcgattatccagtataagcgcatataattcatgctcgtctccctttgaagcaatgtacttgagaactagttcacgtctcctccattcgttttgtgcatttgtccaatcgatcatacgacggtcaggatcatatgtctttgctttaggctgtccgtcaaaatcaggcgatcctagcgtaatcttctttttttcggcttcatctctccaataccaatatttagacaaccattcacgagccatgtcgcacgattcatcacgtttatacttttcaaatatgctattcacttgccctactccccttgtgatataattattttgttatacatatatctcaagggcgctctcacagtagagcgtcttttttcattaaacagctccaaacattagtaagacaaacaatccaaagactgcatatccaatcatgtgcttatcaaagccacataaaatttccgtgataataattgctgtaaaacataccagaggaatgtatttcaataaatccttaatcattcttttcctcccgctttaatttattttcttctcgccgttgacgcttcttgcgtcggcggtttttacttttgctctttgactttgccatgcttgatcacctttcttggcaacaacgcagctcgtggatgagccatcacatatttctgcgcatcatctaattgctcaaagactttgataatctctaaaacaccgtaatcatctactagttgatctttgacaacgtaaactgtgccaaaatcactttggcgcttgaactcaccattagtgattgctttaatcgctgatacctgcgcttcgttaaaaagcatccggttgtttgctctaatgccactccctgactcagagtagacaacttcgccatcatatctaatcattagtcgcacctctcataagttttacgaaatttttcatcactcattgttttccaatcagtgaatgtataatcaaatacggtaatcttcccaagattaacaatccaccaaccacgttttagcggtaaacaattattatctttccgaaaagtaaaggtttcaccaaagccatcatcggtaatacaatatttcttcatcatttcatctgacccatcgaactgttcagccttaattggaactatctttttatatttgtgtagcattaagcgatcacctttcttccacaataatttgcgccttcttatagtgatttggcgccaacatagtaatttcatagaatgcttctggatcaacaggatctccaaaatcacgcttagaagcagcacgccaagcttcatcctttgaatgagcaacaatgactttagatgagttgtcatcatcaactagataaaagtgcattacaaacgctccttaatctcatcaatccgttgcaaaagtacatcagcatacacttgcatagcgttgtactgaataatcattaagcgctgctctttatcgcttaatcggttgtactcgtctgtgtgcatgaactcatctagtcgattcattctgcctgcaacttccgcattctcttttgaaagtttattagctaattcaatgttagtggcagtttgtttatcagtaatttcaaaactaaatgattgaacattgtctctgttgcttctgcatacattaataatttggaagttgtcccattttacttttttgataaaatcattgaatatttcttcttttgtcattatttttcctcctcgttcagtggtcgaccacacatagggcaacaattaatagttaaattccagccgccaaacacatagccatcgtcatctccaatgacaatattgttatctgtcatgtctttgttcgatgcatcatatttgatagttaagttgccattagagaccttaggatctattgagacacacaatcccggtatgttgacaatattctttttgtgatggcaatacgggcaattcttttgcttttcagttaatttcattagttgcctccagatatgacctcttcaacgttcatattcttaatgtctagttcttgaacatcatattcatctatccacgattcagatattacttccatctcattaaaccaagctagttctttagctctttcctcattagcagccttaacaatatagctatcaaaaaaagcgttaactctatacagctttatcattctttataaacacactccatttcgtcttgctcttcataccgccttataaatcaattaagttggcaactacaaaagcaataatcatcaatccaataatcagactaaatattgtttcaaggctaaccttgcagataattattgtgataataattgccgttacacagacaatccccacacataacggtaattgcttcattacttccacctctttcgattcgtcacactatggtgtttctttgattttgatagctcatttatcgatattccacaggaacaaatcgcattagcaattatgtttagtgctttgtatcgctttctttgataaggcggcaggctcattaattttgctttcatgatttgtcgcttacgagtacgcttgctcattcaatccccgcctctttcagtttttgatctaccatgatttcaatacgcttatatccgctgtctatttgcttggctagttctcgcaatgaatgaataggtcttccagcgtcaactttcttttcgtagaacttgatagcttggccatacgtgttgaaccaccacttttgtcccgatggagtaccgttctttcgcattttgccatctttctgaacaatgttgagcgcttcgccgtcactgacgatggcaaacttattatctaaatcaatcgttatcatttttcttctccgctaacattttcaatgcttctaagttagttcttgtgcttgttgataatacttttacttctgtgctcattgcgctacctcctcacagtcatttagttcttctaacgtactccagggccatgagccatttgggctatcggcttctgaaacgtatttaaaaggctggtgatttatagctaagtagggcatacgcttatgaatccagcccccgtcatttaaatttcgttcgtaccaagagtgatctttcattacgattacaagatcaactgctaactcttgtttggcgtcttctggatcatgattgagctgagaaaaatgaaaactaaattcttcccaattcattgcaagcttgccatctgctgacccaatccatgcaatctcctcttctggagcaaaaattaaatcattaatctgcttaattaagctattgtttttcatgctgtctttgcctccttgtaattccaattggtgcaggctttgtcacgtattaaacaacactgatggcaccattctttagcctgttgtttctttttatccccgacaggctttctaagtagccatttaaattgttctttattccaaggtacttgatactcgcaattatgctcatcaagcatttgcagataataaactgctatttgtagcttagttttgataaaacgcaggttagcagcttcttgtgttacaccgttatattcactatcagttacttctaatagcttccgagtagaagcccatttctttttcacttcttctttagtcatgtggcatcggatccccactatcatcaattctttcgtagtgttgtttgttaggctgttcttcttgttgctttttgaaccactctggcattggttcgttaattggttgacgtttacgtgagccactcttttgctgatattcacggctcatttgttgctcgtgttgttgttcagactttttagcttgttccaccgttttaattgactgttgatcgtatcgttcaaacgtttttgctaaatagcgatcagcgcccttagaagctatatttcttcttaatgcatacgtaattacatgaagaactaagtcagctccatatttattcgtccactcagttaaatcttgttgagcaattccattaggaaatccccagttgttttgccaaagctcgaaaacatctttgacggaatgctgtgcatcacttaacactttattagtattatttaaatcagtattagtgttatcagtgattagtagtccttgattttccggaatcggtttttccgatttcgatttttctggtttcggtaaatcgcctttcggcaccgaactgtgattttctggtttcggtatttcttggagaacataatcatacgttgaaaatttaccgtctttccgattttgagttcgcttcaaatagccaagttccattaactctttcatcgcactgcttacagctgattcaccatctttaaaatgtgtagcaatctcactgatatagaattgccaatcatctggcttactccacatatacgcaaagagtcctaaggctttaaggtgcattcttggatcattgattatgtcattatcaatgatcgtgaagcctttaatcttaatttttttaacgcgtgccatgtttctatacctcgatttcacttgcatgtataaatccgcttaacatcttcgtttcacggcaataatcacatttgccacaatgaacaggttcttcttctccagtcatcactttccaaaaatgcggttgtagttctttcactttgtctaaatcggcttgcatttggtaatcatcatcaacgccgttaaaatcaattgccattttgtcaggaggcgtttgcttgctgatcgcaaagataagtggctggcactttttaccaaaggtctgcttgattaattcacgataaacggccatctgtaggtcatattctcggtcttgaataaatggcacatatctatgttcataagtgttccagtgacccttgtggatgtcgtcaacggtcttcaaatcacagaagtagcctttatcaagcacaaggctgtcaatcttgcctttccacaagtagccgtcaatctcacctgttacgattacttccttgtcgcctggagcgtagaagtaattgaacatatcatcggcttgcaacgtttgaatcatgctattagcacccttaaattcagctctaaggtgtccgtttggattagtttttgttgggtgggtcataagtgctttcttattctcttcgataaagtcttggtgactcttagcgctctcaaagtaagaatgtacgtaattaccaacaagaagaggaacagggctagaaacgggttgccaatcctccttgagcttagctaatgcacgagcttcacacttctcaaaatccttgaatagtgagacactcatatattgccaatcggtctcatgagagtagtaattatcagctgtcagcttcatcggctggcttgattgttctctcgttgaagagttctgtttgtccgtctgcaatttcttcacttgattcttcattgctgttgccactattgcttacccctttagcctttgcttcttgtgacttttgaaatccttctagtaattcatcagtactttgtttttcatcctcaacaggtgtgacatctcggcgctcatcatcgtattcgttgcttgttgtatcgttgatagcacccgttaagaggtggtcgctatcatcagaagtgttaatgaacatcttagcggcacgattaagcacagtacgctttgccatttctgagccgaacttattctgtacgtcatgcgtcttagattgattccaactaactttgatctgtttttttgtcataattgttaaatgatccacaccatcagcagttgtaataatggcataagctccaattaattcattgtcttggttcgtccaatcaagatgagtgttttcagtatcaaggactaaatgtccatgacgatcaatcgaagtatttacttgatctccttcataaattgcttgagcatctacatcagtaatgttctctagccttagaagagcagcggttgttccaaaataactgcgtcgcaactgtaattcgttgccataagcgataaaatagcattgatcttttgcggggcttaatccttgcaccaccatatccatcaaggattgaataattgaattaggcgtacatgcttgtaacacaggagttttacctttagttttgacagcttggagccttaaaagtgcttgtgttagcgcatttggaacactgtaattcgctggtaaatctaagccttgattttgctgtttatttatacgtgcatctattacggttcttaattgaccaacagctaatgcaccagtttgattgatattaacgctactaagaatactatttgctttgtcttgcaattcttgattaatcgctacttgattattcatgaactagtccctcctcatcagctaggcgatatgcctcagcttctacttcttttgcatcttgcttaaaatcgctctgattatctagatcgtctaacagatatgtcattgcccgtgctatgtcataatcataagcgccatcgcttaaaatcagattcacgttatagaggtttcttgctaaaactttctgcattcttttaagtcgttgtttataaaattcattcatgtgttataatctccttagtgttataattttcttagttacttattgccatcggctgtgtcagagccggtggcttttttagtctttaaatcccataacatcagcaggtagaaaaatagtaggaatactgctcctccataatctcctaagcctgtgcaataggttatccatgcgcctatcagcattgctgttactttggaattaacgatctttgttagtgtcatttgtttcacctcctttcactgatataatcatctcgttaggaggtgattatttatgcaagataaaattgttgttagctctttttgggcaaccgtattagtaataggcacattactttctcctatagtgacaattattcttaatcggatttttgatctcgttgcgaaacgccttaacaatcaacacgaaagatatgaatcttataattctcggagaagagaattacttgagcaatatttagttggtttagtagaagcagagagagcagaaactcctgaagaacgaaaaaacttaaaattgattgaagtgtcttacttactgattccatatttaccaaactatatgcaagaaacttttcaacgttatgctcttgaagctgctaaccgaaaacatgacgcaaaaagtaatgcagattttcaaacggttaccatttttattaaagagttgctagacccacgaggacgcagatggatatactccacaaagcataaaaaatggatttggaagcgtccaaataaagcattatcatgtttccgacaatggcggtcaaaatggaaatagttagtaaactcatctacctattcctccttaacaaacgtaattcttgaaatagctgatttacttcttcaggagcaggtcggctatttttatccgacaaaacttttaagatgtaagttgctaatgctttgtataattctttttgcacgtcactacctcctaatgcttcttctgataacgtggcttaagcacgtttagcttctcaccttcgataacgttgacaattgctccaattaagaagcagccaataatcgtcaacacgcaccacgctagatacgccatttaatcacctctcaacgcttttacatatggactttcatgatcttcgtagtatctttctgatcgaaatgtttcaaacttttgatattccttcagatcaacgcgaccactggcaagaaatactttttgccaatctggatagttttcttgtgcccatgacctgcgtctgttaaaggttgataatgacataggaacttcaatttccttatttccaaccttttttattgacttccaaacattgcaaaactctagcctgttcatctggtataaatatgggctcatctaatcacctcctaagcctcaattactggtgcatttaagaacttattaatgaaatattgttgtcctttgccagtcactttcgttgtaatgttgacagttgtatgcccatcagaatgattaattactgtttctttagtcttaaacaggcctaattccatcgaacgctgagtaggaacattacgattacttcctcttgttcccaagtagccattctttctcatccaagcaaacagtctattttgcccaatatttactccgttttggcgaaggattttggcaagctgtccaattagaatgcttgagttgcttgtagaaaccgcgtccgcaaacagtgcctttggcttcatctgctcgttctctgcttgaagttgcttacgttgctcttgttccctttttaactgagtagcaagattaatgattgtatctggattaagcagcgctttttcaatcgtttgtggtgtcatataggcaccatgcttacggatggctggtagcacttcacttgttacccagtgcttgaattctttggcggttggtaacttgctaccaaggattaatgaataaagacccgattcattgatgagtgttacctctcgatgttggcctgccagaacgattcgttcagtcagcttgtcatctgcatcaacgtggtctcggattgcctttggaccatttgaatactggaggatagccgtaagatcacgtccaataaaatatggttcatcgttaagcgtcattgtccggacttgttgtccatgaaaattaaataattgtggttcgttcacacgagtcatctccttttcagtaaagttcatttcgataatcgcaatattttatttaaaaattttttcaataggtatccctagtttctttgctaaaggcggtaattcggtagcttgaaatctatatttcccttgttcacgacgataatatttttctggttccttaaggcctaaagcagaagccatatcaccatacgtaaagcccttttttgaccgtaattgtttaattaaattaagatttatagtacctggcatttattaacctccttccattacattgcgataagcgcaattaatttacgattattatattacattgctattttcgcaaagtcaaggtttttattgcaaaaatagcaatatatattaaaaacatttgcgaattgcgctatacttattgcgtaaagcgcaacaagaaaaggaggccatccgtttgaacgatgacattttacgagaaaagataataaagctacgagaagaacgtggttggagtcaggcagaactcgctcgacgcataaacatgaataatactgccttaaacaaagttgaaaagggaactcgcaaattgtctagttctgaactcagtgagttggcttctgcttttaacgttactactgattatctcctcggtcggacacctacacctcaatttactcggcgagatgaacgtgacgtacaaaaaacacttgaagaaatgttcaacggtttaagcgataaaaacgccctttcctatatgaaaaacggcgaccaagaaattgatgaagaagatgctgaactattacgggcttctcttgaaaatgcaattcgtatgtcaaaaattcttgcaaaaaagaaattcacccctaaaaagtatcgaaagaacgatgactaggggtgaatgtgaatgcgtaatgctgattggataaaacaaaaagcgttagaagttgtatatgatgctggtacaaataatcctatgaaaatttgtgaagagaatgggatctacgtttgtcaccaagatcttggcaaagcttttcttggacactatacaaatataagacgcatcccattaatcacgctttcatcgcaaaatagtgaatttgaaaatacttatacatgtggtcacgaattaggtcatcattattgtgatcatgggaataacaccgagtggctttcaaggcagaatttaaaatttaatacttggggttcagaatatgaagccaatctttttatggttaatattatgttagctgacgttgacttatctgaatttgaaacaaaggaacaactactaaaaacatatggtattccactctgggcatcacgatacgttgatcttttaaagtaaaacttttcaaacaaaggcgaagaacgaaaagaaattatcaactgggttaaagaggatgactaacttttatgaccaaaatctgatgtcgttaaaagctgaattttatttatattaaggagtgtcattttatggctaagaaaattacggataaagatggaaatgtctatgtgcagaaaaaggcatggtataaacgttggtgggtatgggtaataattgtacttgtactattatttggaatcggatcaatgggaagcgatgacaatagtacttcttcatcatcagatgcagctaccgaaagttcaactaaatcttcaagtagtagtacccatgcaacttcacagcaaactgctgcacttcattcagccgaaacatacgctaatgatatgaatatgtctaaagcagctatcttagatcaattaacttcagatgctggcgacaaatttgcccaatcagatgctcaatatgctgttgatcatgtaaaagctgattggaataaaaacgccttaaaatctgcagaatcctatcaaaaggatcaagatatgtcaaccgaagaaatccgcgatcaattaacatcccctgatggagatcaatttactcaggaacaggctgactatgctatcaatcatttatcaaaataagcaataatttatatattattaccggcattatgccggatacatagttgtccaaccaaattgatgacattaaaagctatttaatattcaagttttaaaccggtcgaaatcgaccggtttaaaaagcactataaaagaacgtatgtacgggaaggactgtttattatgaataaaaatgaactgctggaatatatagatactaactccaccgccattactattttcaaggataaggtacgaactgagcaggaagccaaaaataaaaagcgtcaacccgctaagcgatggaacgaagctaagattgagcgcaccgtagataaatttaccgatgattttatcagtaatgtttacgacaagttatataagggggtgaaagccaatagaaatacaccaagaaataaatggattgagtttatcgaaactaacgaaatccttgatagtttagaagaatcagtaagtatgatggagattggagaagattaattatgtggatgcaagaacgcaatgggaaattccgcttctttgagcaatataaagatcctctaactaataagactaaaatcattagtattacaatgaaagaccataaaaagagtactgctaagcaagctcaaattattctagataatcgcatatccaaagctttatcaaaagtcggtatcggaaaaataattcatggaattacactcaaacagttacttggtgaatatactaaatatgaaaagccgcgaattaggagatcaacgtattatagccatcaaacaatggttaataccttactagatatttttggcaacgatgccttagttgaaaaatttaccccgcttatcattactgaaaaactagaaagtctaatgtatggggatagagagttgtccagtggctatgtatcacgatataagtactatctacacaagttatttgattatgccgtaaaacactcatatacaaaagataacccagttgataacgttaaaattgattataaggcccctgctaatggtcaacaaattaaagataagttcctcgaagctgacgaactgaaagccgtgctcaagtatctatataacaatactagaatctacggagaactttgcgaatggttatatctcaccgggctacgttttggtgaagcagccgctttaagttttgatgacgtttaccaaaaggacaatcattggtttgtagatataactggcacattagagtataaacgaattaaaatcaaagaacaaaaaaagagtgacgcacctaaaacctcatcctcagtccgtagcgttgtactaccaaagaaagccgttcaaatttatcttgatctgaagaaaaaatctaatggcaaaggttttatcttcgcaaccgaaaacggcacaccgatccaaacggcatcagtaaatactgttttaagatcagcaaagaagaaacttaaacttaataaaccactaagtactcatgtattcagacatacccacatctcgaaaatggccgagttaggaattccgctatatgtaatccaacaaagagttggtcactccagtagtaagattacctcccagatatatcttcatgtgacacaaaaagcaattgaaaaggaagcgtcaaaacttgatgaactataaaaacctaccaaaaacctaccatttgcttcgaaaaattatttttactctttcttttttcttaaaaatgattttaaaacaaaaaagaacccttgatacacaagggttctgcactactagttgtcgcgacgacgttcagcgatacgagtagccttaccagtacgttcacgtaagtagtagagcttagcacgacgtacacgaccgtaacgaagaacatcaatcttgtcaacacgtggtgagtgaactgggaaagtacgttcaacacctacaccgttactgatcttacgtacagtgtaagtagcactgataccagcaccgtggcgcttgataacaacaccttcgaacatttggatacgttcacgtgaaccttcaacgatccgagcgtgaacacgaacagtatcaccggcacggaattctggaatatcatcccgtaattgactagcagtaatcttttcgattaacttattttgacgcataatatatttctttcctttcgccgacattcatgtcctgtatgacgggcagcggaataccgttattcacagctaaacagccaataactactatacattgttttcggctgtctttcaagggtaaattaatgggtttctttattaatgattgaatgacgaattccatagataaagtaaattaacaaaccgatcacaaaccaaccaaccattaaaatttttgcatcagtatttaggccccagaagatcactgccgaaaagatcgctgaaattgctggaagcactggatataatggcatcttaaactgagcttcgggcaaatctaccccttcccgcggacgcaaggcatagattcccagagaaacaaagataaatgcgaccagagttcccgcagaaacaagggttgctaagaacgtaaacggaaaaacagaacccaagatcatggccaagaaagtaatcatccataatgcatgattagggacgtgcttatcatcgatttgtccaagtgattttggtagtaacccgtcccgtccaaaggcataaattagtcgagaggaagctaaaagaattgcgattaatgccgagaaaataccaacaatcgctacaacggaaagcaagttcgccgtaatatagtgtcccgactgtcttaaagcccaggctgctggttctgcattatttgcataacggctatatttaaacatccccactaatacgagcgaaactgcaataaagaagcctgttcctagtaatagcgtcccgatcaatcctcgtggcattgtcttttgcggattaatcgtttcagcggtattagccgcaatcgcatcaaagccgacataggcaataaagatttgcgcagtcccagctaatatcccctgccagcctccaaaagtggtgcctggttgatgagcagggagaaatgggacatagttttgcggatggattgcagttgcccccacaacgataaacattaaaattactagtagttttacactaacaataatattttcaatccggctaacctgatgaacgccacgggaaattaagattccaacaattagaattgcaaaggcggccagaatatcaatataagaccctgtatgtggatcaaacccaccagttaaggcatgcggtaatttaatcccaaagctgcctaaaaagccttgcatataagctgaccatccagacgcaacaaaggcgactgaaataaaatactctgctaaaagcgcccaaccagcaatccagccaaagaattcaccaaacaaaacattgatccaggaaaaggcggaaccagcaaaaggtagtaccgaggacgtttccgcataagctaatgccgataatcctgcaccaattgcggctacaatgaaggccaatggaaccgcgggaccagtatgctcagctgccacaatccctggtaaagtaaagatagccgttcccacgaccatccccgttcctaatccaattaagtctcttgttcgcaagctaggggttagttgcgcatccttttcttcataaacgcgggggttctgcttaagaaataatcgtttaattaattttttcattcacgtcaccttagtctggaacagttggatcttcatccagcttaatatcttctaacattaattgttgttctcgactgagcttagcggtttttaaaagatctggtcggcggtgaagagtccgtcgtagtgattcgcgcatccgccattctttaattttctgatgattaccactcgtaaggacttccggtactttcatcccccgaaaatctgctggacgtgtatattgaggatattctaacaaaccgttactaaatgaatctcccattggtgaagacatattaccgaggacaccaggaacaaaacgaacggttgcatcaatcatcaccatcgctgctaattccccacctgttagtacataatcaccaagagaggcttcatcggtgactaaattacggattcgttcatcatatccctcataatgaccgcagataaatgttaagtggtcttcttgggctaattctttggcgtaagcttgatcaaactttcgaccagcgggatccattaaaataacccgtccctttgaatactgatctttcgtttgttcatgaattgcatccattgcgtcaaaaatcggttgcgcttgaagaagcatccccgctcccccaccaaatggcgcatcgtcaacatgattatgcttatcggtagtatattgacgaaaatcggtcacattaatgtcgataaatccattatcttgtgccttaccgataatggattcccccattgttgcttgaaacatattggggaacaagcttaaaatatcaatcctcattattcaagtccttccattaattcgactgttacaaaattcttatcaagatcaacgtttttaacaacctcatcaatcactggtaataataaatcccgtttttctgggcgttcaacaacccacacatcattcgcaccaggagatagaatttccttaattttccccaggtgacggccatctgttgtttcaacgtctaatccaataatctggtggtagtaatattgaccatcgtctaagggttgttgatcatcagcactgaccattaattcatggtcacggaattgttcaacatcattgatattatcgtagccgacaaacttaacaagaacaaagcccttatgttgccgcgtactttcaatcgtcaatggtaaaggttcgcctgattgttgtaggtacaaggtatttcccttggcaaatcgttcatcaataaaatcagtagttgctaatacgcgcacttctccgcgaacaccatgagtatttacaattttaccaacattataatattccataaattcctccttaaaagacaaaaactcccacagattagtgtgggagttttaaatttagtgacgatggtcattaattaataaccggactcgcttagagttagcccgtcgagattgagtaccctcgactattgttcgcaatgctgcggcaacgtgtccctgtcgaccaattagacggcctacatcattgggagcaacatcaattatataacgatggtaacgtccatcatctttttgggtaattgacaatgcctgtggctgcttcaatagcggaataactaaactacgaattaacgactcaatatctgtctcagccatgactgattatcactacttcttagcgtactttgcttcgtggtacttcttcataacgccagctgcttgaagcatgttacgaacagtatctgaaggttgagcacccttttgtaaccattccataacagcgtcttcatcaaacttgacttccttaggagtagtcaatgggttgtaagtacctactgaagtaataaaacgaccatcacgtggggcacgtgagtcagctacaacgatccggtagaatggacgcttctttgaacccatgcgctttaaacgaattttaacagacattctttgcacctccctgatttcttttaacagataataatataccagtgttcaaatagaatgtaaagtattttttcttgacaggcttaaattttttgaaattattttttctttcgtaatttgcgaagctttttaatgcgcttttgcttgtcttttttcatttttcgcgccatgcggttcattgccatttgtcccatcttgccacctggcatttgtccgccaaacatattttgcattccattgaagttaccgtttgtaacctgcttcatcatcttacgcatttgattaaattgcttaatcatccggttaacttcaacaattggccgtcccgcaccagctgctaaacgacgacgacgactaggattcattatatcagggttttcacgttcttctggcgtcattgaaagaacaatagcccggatatgagcaaattgcttaggatccaaattaagattcttcaaggcagggttattagccatccccggcatcatcttaataatgttttccaacggtcccatcttggtaacctgatccatttgtgccaagaaatcattatagtcaaatgtgttttcacgcattttatccattgtttcttgggcttgttcttcatcaaaattcttttgggccttttcaattagggtcatcatgtcccccatacccaaaatccgtgaagccatccggtcagggtggaagacatcaagatcctccatcttttccccttcaccgacaaacttaattggcttacctgtgactgcccggattgacatggcagccccaccacgagtatcaccatctaacttggttaagataaccccggtgatatcaagcttatcatcgaatccttgagccgtattaactgcgttttgaccagtcatcgaatcaataacaagcaaaatttcatttggatttactagctctttaatgtttgcaagctcatccatcaattgttcatcaatctgaagccgaccagcagtatcaataatgacataatcattatgatttttttgggctacttccatcccttcgcgaacaatttctaccggatcaacgtctgtccccttttcaaaaacaggaacatcaatctgatcagcaacttgttgtaactgcgtaatagcggcgggacggtaaacgtcggccgcaataaacattggccgcgcatgattttcattctttaatcgtaatgccaatttaccggcagtggtcgtcttacctgccccttgaagaccaaccatcatgataacagttggaatatgcggtgctttgttaagcggaaccgcttcttcccccatcagttttgtcaattcatcattaacaattttaacgatttgttgggctggatttaacccttttaatacttccgccccggctgctttttcccgaacggtctttacaaagtcttttacaactttaaagttaacatcggcttctaaaagggcaagccgaatctcacgcatcgtttcccgaagatcagcttccgtaactttgggtttgcgtcgtaatttttccatcgccttttgcagacgatctgttaaaccttcaaatgccattttattcttcctccaagctttccagatgatttactaagtgattgagcgttgcatcatctggatagttttctcggacgtatcgttgaattcgatccgcctgttgattacgaacttgaaattcagcatacaaatgcaatttggcctcgtaatcttctagtatgctttctgtgcgctttatattatcatatacggcttgacgactaacatggaaattctcggcaatttcgcccaatgagtagtcatccccgtaataaagctctaaataatcattttgttttttggttaataagggttggtaaaactcaaataatgaatttatccgataattcttttcaatttccatatcgtcacacctgcctagtcaacttcgactaaccccttgaacaggccataaacaaagtcgccagcatcaaacttctggaggtcgtctaccttttcaccaagccccacatacttaaccggtaagtggagctcattacggatagcaaggacaattcccccacgagcagttccgtctagttttgttaaaacaatccccgttacatcggtactttccttgaatagtttagcctggttaagagcgttttgcccagttgttgcatccaagactaacagtacttcatgaggagcatctggaatttcacgagtaaggatgcgcttcatcttagctaactcattcatcaagttaaccttgttttggagccgaccagcagtatcaacaaacaagatatcatagttttcatcttttgcccgttttactgcatcaaagacgacagccgctggatcaccgttttctggccctgtaacgatgtcaacaccgtcacgttttgcccacacatctagttgttcagttgccccagcccggaatgtatcagcagccgctaaaagaactttcttaccttgtttcttaaagagggcggccatcttaccaatcgttgttgtctttccggcaccgttaacaccaacaaacataataacagttgggccttcctttgccatggttaagtcaggattttcatcttgaccagcttcatcgtaaagttcgaccattttttcaataatgacgttggaaacatcctgcttgctcttagcgttttgcagttttacttcttctcgtaattcatcactgagtttcattgccatatcatagccgacatcagattcaatcagcatatcttcaagatcatcaaagaagtcttcatcgacatgccggaagttagccaagaacttatttaaccgtgctccgaaacctgtccgggacttctcaagcccgcgatcgtatttcttaaccgtttcagtttcttgatcctcttctggttcaggagaaggttgttgctcctgctcctcatcaccatcattttcttcagaattgtcatcctcatttgatccttcagcagctgatgcttcttctgccgcttcctctgtggttggcattactggttcttcaactgtttcttcttctgcaacaggttcggtcggttcttcagtcggttcaacggctgtctcagtttcagcaatattggaagaagatggttcttctgcagaaacagtttcatccggagtactagatgatgatacttcttctttagaaatacttgagtctgccacctcttctgagtgactttcctcgctagtctcctcttctttaaccccgttatggagcgtttcacgagttccatccgggttaatcttttcttcatagctatcggcaggaggaatatttaccggttccggatgaattggagcagaagccggcgccgcactcgtcgtatctgctgattcatcttcaagcgcggtttcagattgaacaactgcgcttgaactatcaggcgttttttcctcttcttttttcttatgacggcggaaaatatcaaataatcccatacttgaagcctcctaaatttagttaattatcactctcttgtaaagtatcaacaacgtccactgataccatctttgaaactcctgattcttgcattgtaaccccgtacaatacatcggcgtccatcatcgttcccttgcggtgggtaatgacaataaattgtggaccttcagtaccaaatttgctgaggtagtgcgcaaaacgttgtacattaacctcatccaaggcggcctctggttcatcaagaattgcaaatggaactgggcggactttcaaaatagcgaatagtaaggtaatcgccgttaatgctcgttccccacctgataacaatgaaagatgttgatttttctttcctggtggctgggccataatatcgaccccggttgttaataagtcatggggatcggttaagacaagtttagcatgaccaccagagaaaatttgttggaacgtctcatcaaacttttgtgaaacctgattaaaggttgtaataaaccgtttcttgacttgggcatctatctcacccatcgtttgattaagctgagctcgagaggcgagcaagtcgtcttgttggccctttaagaaatcgtaccgttcacgaacgcgctcatattcttcaatcgctcccacattaacttgaccaagatcatctaatccccgctttaatagcttcaaccgggtcgccaaggtctcttcatccaatttactcatctgctgacgagcttcatcaatggtcatggaatattgctcagataatcgattaagagcttggtcaaccatggattcatacttcacgcgctcttcatttaagttattacgatcatctagggctgcccgctgaagttcttgcagacgattataatgtgcttcggcttgtgacagcttttgctcaagttcttcaagagcaactgaattatcttccagttgcaccttagcttttgcctgctcttctttagcatcttttaaggctgtctgtgtcgattgttcacttgttgattgactagctgattgagtcgttaattcagcgattgcaatcgtgaccttttctaaactctcttcaacttctcgccgttgccggttatactcttgactttggcgttgatattgttgaagtcgttcttccgctaccgcgattttttgttgcatttgcgccaattgtcgtgcctgagtcgactcatcattctgtaattcatcaatctgagtaaggatttgcttaatctttgccacaacttgcgtcaattcctggtttactttatcagcttgttcattattttgttgaacttgtgattcgtaatcctgatgttgagtgtcttgctgtttattttgggtttctaaaatctgtacccgattagtaagcgtctcatacttacttgagatcaactgacaactactttcttgctcatgaaacttatcttgtaaagtctgaacttgttgctgataatcagctactacttgttcgttcgccttttgcgcttgttgtagtttagcaacttcttgctctaagtttgctgcaagctgttcctgtttttttagctcctcttctagttgtttagccatttgcttttgacttaagagtcctgtccgttggctacgggtggctcccccagtcattgctccactagcattgatcaactgaccgtcaagggttaccacccgtaccatatgacgacctgcacgggcaatctcagttgcatgatcaaggttgtcagcaataaccgttgttcctagtaagtggtcagcaataagctgaaacttttgatcaaacttaataagttctgttgcacgacccaaaaaaccaggaaggccagttaattgcggccaaatacttaatggtcgccggtgactaagcgtatcaagcggcagaatagtgacccggccagcgcgcgtcttaatcaagaagttaataattgctttggcagtagcttgccgatcaacaactaattgctgaagctgacttcctaatactgtttcaatcgcttgcgtgtacttggcaggaacatcaaataattcgctgactgctcccgccaatccaggaaattgctgccgttgccgaagaacctcttgaacgccccgataatagccgctatattcatcggccattgactggtaagcattaattcgcgacttaagtgaccgcacatctcctaatgctgcataccaatcacgttgttttgtttgatacccgtaattaagtttttcacggtgatcttgagccgcctttagtttttcactgacattctgcagactttccttagtaatagccactgcttgttggtagcggtcgaattcctgattaatttctgcaagttgattcttagtagcgtcaagttcctcgacattttgtcgttgaagactcatcgcctgttcatgattacgtgacaagaaagattgctgattgtgaatcgttgttctttcctgcatcaagctaacttgttggttacgtaaatcctctacttgctgttttagggtcgcgatccgctcactgctactcatctttctggctgcttcgaactcagcttgctgactattaatcagcgctttttgttcagccaattgctcgtcatttgcccgttggcttgccttaacctcttttaagcgtgcattgagttcagcctgttgggcagttaaccgtcgctgctcattttcacgctgctcgcggcgaacactggaaacagattgctgattttcgtacttagcaattgcctccgtttggtttaagatgattgcttgaagtcgatccttagttgcgtttagttgttggcgcttttgctttaaattatcaagttgttgccgatcatggcctgcttgtctttgatagtccttcaccatctcttctgcttgtttgagcttggcacctaatttagttaactttccatagtactcatcataatgacgaactgtttgtgtccgatcaagcacatcaaattgtttcttttgttccaagtaatcttgggcaattgcactttgttcttctaaaggttcaatctgcttttctaactcactaataatgtcatttacccggttaaggttttccattgtcgtagtaagtcgcttttcagctgtttctttgttcttcttatacttagcaactcccgcaacggtttcaataattccccgccgatcaattggtttaccattaaagatctcttcaatccgtccctgggaaataatggaaaaggattctcgacctaaaccagaatcaataaataagtctgtaatgtcctttaagcgaacgttttggtcgttaattaagtactcactatcaccattgcgatatattttacgagtaatggtaagctcagtaaattcactagctaagtaatgatcactattatctagcgtaatcgaaactagggcccggtttaaaggtttacgatctgatgacccattaaagataacatcagccatccgatctccccgcaaatgatgagccgactgttcgcccattacccattggatagcttcgataatattactctttccactaccattcgggccaacaatccctgtcatcccgggctcaaatttaattgttgttttttgggcaaaggacttaaagccgtccaaagttaaagacaataattgcatcagttattcctacttactatttatttttatttctcatattatcaagtgcctgttgtgctgcttgcatttcagcatgtttctttgatgagccctttccttcaccgataacgtcaccattagcagtaacatttactttaaattcagggtcgttttctgttccgctttcctctaccaaatgatattcaatggcaatatcaccgtcacgttggaggaattcttggagactagtcttggcatcaacagcatgatcaaaccagcccatatcaagtttaggaaagataactcgttgaacaaatttttcgactgctggtcggccttgatctaaatagagggcaccaataaatgattcaaaaatatcacatagcaagcctggacgttctcttgcgccagccatttcctcaccatgacccaagcgaatatattgatcaaagtgacattccttggcaaatttagaaaaactatcctcacataccattgccgctcttaagcgggtaagttttccctgtggcaattcagggaaacgtttataaatatattctgaaacgatcagttccaacacagcatcgccaagaaattcaatccgttcgtaatattttaatccttggttaggatgttcatttacatacgaagcttgagtaaaagcttctgctaataaagcaggattatcaaaatgaatattaaattccttggccaggtagtcttgtaattcttcgatcataaaaaattcctttcgtttttgacttaaaattataaaaaatgtctaaggcctattatactaaacaacccgctattccgcaggtaattttaataatattcaaaaaattaaaggctgtgaaaaaactttcgccttttctcagccccttacttttctaccttaataattaaacagttcgattagttggcagtgtgttctgcgatgtaatcaacaacttcaccgattgtacttaatttttcagcatcttcatcattaatttcttcaccaaacgtatcctctaattcgagaacaaattcaacaaaatcaattgaatcagcatccaaatctgtctttaagttcaaatcatcagtaatcttagcccgatcaacatcaaaatggtcagcaacaatctctgaaaccttattaaagatttctgttttcttattatcagccattattattaacctctctttactagttcgctacttattctattcgtttttctgagaattgtctagattttcggtgctatcgaaaaattcaactgttttttcaattacacctgttttgagcattgttctaatttgactaattgtatttttcacggctaaagcatcagcagatccatgagttttaacaactggtgccttaagccctaataagaccgccccgccataagttgaagcactcattttttgaccgatttgatggaaaactggctttagcatgagatagcccaacttagcacggagaccaccatgtaagattccatctttaattaacgtcatcatcatcttagcagttccttcagtcgcttttaaggccgcatttgccgtccacccatcgcttacaacaacatctgccttgccaaacaggaggtcaccagattcaatattgccgacaaaattcaaatcatctttgctattgaggatttgccatacttctttatgtaacttgtcacccttatcttcttctgccccattgtttaatagcgcaattcgagggttcgcaactcccaatacattttcggcatagaatttaccaaggtaggcatattgttccaaatttttctctttactttcagcatttgcaccagtatcgaggtagacaaaattgtgccgactagcacccggcttggcaattggcaaaatactagtaagtcctggacgatcaatccctttaatgcggccaacaatgaagaggccagccgccaaaattgccccagtatttcccgcagagaagaaggcatcagcttttccttctttaactgctgttgccgcgcgaacaattgacgaatcttttttccgccgaatcgcccggactggttcttcacccattgaaatttcttcactggtagcaacaatattaagccgctcgttattttttattaagggttttaccttgtctggatttccataaagatcaaattctaagtcggggtaaaggtctcgagcctcttctaccccttcaatgattacttggggagcattatctccacccattgcatcaacagcaattttcataaaatctcctcctcatattagtcaaagtgcgtctccagttcatgacgctttaaatataaaacaagtggctgattttcatcgacctgatcccacttggacatgcctaataggtttccagcatctgcacgggcaatttgcagcatctttaaatcagcaaccggatcacccactttaaattctggcatccccgattgcttttttcctagaacatctccagatccacgcagtttcaaatcttgctcagctatcttaaatccatcatcggtagcaaccatcgttttcatccgggcttttccttcatcagttttcggatcggcaattaatagacaataactttgccggctgcctcgaccaacccgaccacgtaattggtgaagctgtgcaagcccaaaacgatcagcatcatatataaccattaccgttgcattaggattatcaacgccaacttcaataaccgtggttgcaactaaaacttgaagctcaccagatttaaactggcgcatcgcttcatctttttcttccgtccccattcgtccatggagtaagcccactttataagctggctcaagatcggccgatagctgattataaagatcagttgcgttttgtacatctagagccgctgattcctcaatcaacggactcacaacatacgcctgtgctccctgctttaattgttcacgcaaaaaatggattgctgcggcatgttggttagactgcagccactttgtttgaattggttttcgaccagccggtaattggtcaattatcgaaacatccatttcaccataattagtaatcgctagtgtccgtgggataggagttgctgtcatggctaatacatcaggatgttcgcctttttcacgaagttgctgacgctggttgaccccaaaacggtgctgttcatcagtaattaccagaccgagattagcatattcaactccatcttgaattagcgcatgggttccgacaatgaggttgacatctcctcgcttcatcgccgtcaatagttcccgatgttgcttagcagtcaatgaaccagtcaggagagcaacctggacatgggttccttcaaaaattttcgctaatttcttagcatgttgtcctgccagaatttctgtcggcgccattaaagctgcttgatagcccgcagtaatagctgcataaatggcaatagcagcaacaattgtctttccagaaccaacatccccctgcaacaagcgattcatctggtatggttgacgcatatcacgacaaatttcattaacaacccgtttttgggcatcagttaattcaaatgggagtccgccaataaattcttttaactcgtcattatggtataaaatccgctcgccatcttcttgacggtgggcacggcgaattgcttgcagtcgtaactgaaacaggaaaaactcttcgtaagctgctgttcggcgggcggcttttgcagttgcctgagtttgtggaaagtgaatttccctaatcatttgtcgccgatccattaaccggtatcgttgacgaatcgtttctggcaaatacgttggaatgatattggcatattcctcgtaagcttgacgaataaaactttggaggacattttgccggatatgcttattcaccgcatagaccgcaccaaactcatttcgatcatcagctttttccttaagaagtttgtttcctgttacttgacggcgaggtgcatcccacttccccattacagttacttgctgatttagttcgatttgctttttaatatagggctgattaaaaaaagttgcgattaccacttcattacctacctgcattcgaaaggtaagccggttgcgccgataaccatagcggaccaagagcggttctgataccactactccttgaagagtaattttctgtttatccttggcgctttcaatgtctgtaggcgtgaaatcgttatagcgagtgggataatacgtcaacaaatcttcaatagtatctattcccagagtagctagatctgctactcgcttaggaccaactccttttaaattggcgacggaatccgttaaactccgcaaatctttcacctcttttttaacacaaccagtaaccaaaataggagtgggaataaaagtagtcctttattaacccactcctataggaattaatttaatgtgccgctattcaaccgaaatcaggtatggataaactggctgaccaccatcgtaaatctgaatatctaattcatcatctacttcttcaactgctgctttaatctcttcagcagttttttgatcaccaccagctccatataagatcgttacaatttcactatcctcgtcaagcatggctttaaccatcttaatagcggcttctttcagatccagatccgtagtgacgattttaccatcaacaattcccatgtagtcatctttcttaatttcacgaccatcaatcgttgtatcacgaacagcattagtaaccgctccactggcaaccgtatttgtattagcttccatatttgcttgattttcgtccaaagatgcttctgggttgtactcaagcagtgcgctcatcgcttgggcaatcgtcttactgtggacaatctttgttggaatatcagcaacctcggcagcctgatcagcagtcataaagatgttgccgttatttggcagaacaatagcttgcttagcaccgctattattaatggcatcgagaatatcttgagtgcttgggttcattgtttgaccacctgtaatgatatgggtaacacccaagctctttaataatttcgcaattccttctcctgatgcgacagcaataacagctgtctgaaggtcatttttagcttctgcagctgcttttgccttctcaattggcgactcactgtcagcgtcttcttcatctttttccatgatttcttcttgttgccaaaccatgttatgaatttcaattgtctgtaaatcaccgaattgttgaccccaagataatactttaccgggatgctcggtatgaacatggacccgcacaacttgatcatcgtttagaacaagtaaactatcgcctaagtcagctaagtagttatagaaagtatcatagtcaaacttttgagtcacctgcttacccttaccaagtcgtaccaacatttgagtacagtaagtatacttgatatcttcaggattaagctttccttgaacgctttggtgatccatagcgtgaaccatctcatcaatttcagcattgtcaggtttatagtcatcacttttatctacgcggccactcaaggcttcgtcaaaggcttgaagtacaaagacgagtccttgtccaccagaatctaccacgccaacttctttcaggactggcaataaatccggcgtcttcttaagcgcttcttcacctgcttcataaatagtatgcataatctcaacaagatcatcagtctctttaatcttattgaggcctgcttgagctgattcacgaacaacagttaaaatggtaccttctgttggcttcatcacagccttataagctgtctttgcaccattagcataagcatcaacaaagtcagcagtagataaaacatccatgccttctgttgcctttgcaaagccacggaaaatctgcgataaaatgaccccagaatttccgcgtgctcccattaaaaggccctttgctaacgctgcactcaggtcgccaaccttcttactggtttcgttgcgttcgtacttggcaccgcttgccattgaagaagtcatgtttgtcccggtgtctccatctggaactggaaaaacatttaatgaattaataaattcagcgttcttaccaagtttatcggcggccgcctggaccattttaccgaattcaaggtttgtaatttttgttacagccaattcgaaattcctccccaatgctcgcttaatcttctagtgtccgtacaccttggacacatacattaactgaatttgccgtaataccgagcattgtttcaagattatactttacctttgcttggacactttttgatacttctgagatctttgtgccatagcctacaataatatttacgtcaacagctacaccattatcttgctgccgaacaacaacgccgcgcgcaaaattttcacgacgaagaatttggttaaccccatcacggagggggtttcggcttgccattccaacaacaccgtagttatcagtagcagccccaccaacaactgatgaaatcacatcattatcaatgtcaattgtacctgacttagttttgatttttactgccatcgtcatggcctccttataaaattaccaattgattttagaatcctatgatactaaaattcacaattaaatcaataccatcataccatagcatatttcactaaaaaagtaactgatggatatttttgcaatcaatcaatggggttaatcaattagtgtaaaaaataagccgcccaaactggacggcatcattttaattaaacccgagtcactttacctgacttcagtgtacgtgctgaaacgtataccttcttaggcttaccattaactaaaatggttaccttttgcaagttaggcttccagctacgccgacttgagttaagggcgtgagaacgcttgttaccaaattgcgtccgtttaccgttgataaaatctttagccattggtgataccctcctctttgcttcataattttttcgtttacgcaaaactgcgatgtaactcacctaattaatctaccataggcatcgtaacaatgcaatagttttctttcaagtaattttccttgacagggtattttccactcaaaaacctattttaattggtcgctacactgaattacagaaacaattccactttcaaatgaaaaatgattttcttcagctgtaaattcattgcttgtccacgaaaatggaatttgactactccagttttgcagtggatatttttcgtctttcaacgtaaggccttgaacaggagtaagattgacaaaggccagatacttcttatgcggcaggcgagaaatagtgtaatcccctggcaagtaataagagacaacattttgacagtcaataatcttaatccgggttaagtatggtttaaattcactctgcagcggaagaaagaggttagctaataaatggtctaagcgccctcccgttgcaccaaaaatttcaatttcatcagcctgttcctgaattgcaaatttcacgcccaattgcgtatcggtataatctttttcaggaggataagtttttatacgagtaattttaccttccaaaccttgcaattcatccccggtaacggaatcaaagtcaccaattgctaataccggcttaattccccaccttaataatcttaaagcaccccggtcaaccccaatccatttttcatctttacgttgcaaaatcaactcggttggaaccatttcaagcggaccgccaactagtacatttactctcatttttcactcctaaaaaaatagatcttcaatattcagataaacccgaactagaagatccattttattttttacttaatataactaattacttagtagcatcttcaagagccttgattcgttcagaaggatcttcagcgttaaagacatatgaaccagcaactgctaccgtagcaccagctttgtagcaatctacaaccgtcttgtcgttaactccaccgtctacttcaatatcgaaattgtagcccttttcttccttaattgcgtttaattgggcaatcttgtcaacagtttctggcaagaacttttgaccaccaaaaccagggttaaccgtcattactaagacttgatcaaccatgtgtaataccggttcaatcatcgcaactggtgtacccgggttaataacaacttcggcttttacgccaccgtttttgataatttgaagagcacggtgaatgtgttgagtagcttctacttgaacaccaataatatcagcgccagcatcaatgaacattggcaaaatgtgttctggactttcaaccatcaagtgcacatccaataccatgtttgtaattggacgaatggccttaacaaagcctggtccataagaaatacttggaacaaaggtaccatccataacatcaatgtgtaagtatggtgcaccggccttttctaccttttcaatgtccttttgtaaatttacataatctgcacttaaaattgatggtgcaactttaatcatcctgattccctcatttcttataatttggtttttgattagcaatcaattcatggaactgaagataatcattataccgactcttcatgattataccattgtttaccgcttccttcacagcacattgtggttcttttatgtgaaggcatccccgaaacttacaatctgctgaaatcttagccatttcagggaataactgcggcaaatcatttaccgtcatatcaaatgtctcatacgacgaaaagccaggggtatcggctatcagagccccgttaacatctagtaagcttacttttcgtgttgtatgccgtccccgttgaagtgcttgggaaatttcgccagtcgctaattttaattggggagccaaatggttaagcaaagttgacttccctgctcctgtctgccccatcattgttacaatatttccctttaatccttccatcaaatttgctaattgatcggaatcgaaaggctcacgggccgcatagacctggtagccgattttacgatagccctcaatcgttggcaaaagttgttggtattcatcatctgtcagtaagtcagtctttgaaaaataaattaaaggagtaacatcttgtgcttctaaagcaatcaattgccggtctaaaaggttagcggaaaatgctggttctttagctgaggttacaacaactgccatatcaacattagcaacaggtggccgaaccaactgattgcggcggggcaggatttttaataaatacccttcctgttgattttcagcactgaattcaacgtgatcgccaactaccggcttaatctttcgttgacggaaatttccacgtgcccttgtccggtagatcttttcatctgcaattacatcataaaagccacttaatgattgttggattattcctgttttcaaactgcacctccattatccagtaatatttgttgcactcataatcgttcgtccattgcgaacaacacggtatgcacctgtttctccttgtttaagggtaaatggcacattaattgttgtttcctgattaattgtaatatcttgatactccatcgttaaattatggttggcatctctaatgtatacctgcacccggttttcgcgctgcccaccatttccatcgaatggaatgttaatctgaatattcgtcgtttttgtttggttaccagaattagcaatggaaactgttaacgtatcaccatgatttaatgttgacccagctcgtggtgtctgattaattacatggttagtcgcaattatttttgattttttctcttgagttgtcaattgcaaattatttttatttgcaaactgttgcacagcactaatatcttgattcttaaagttcggaatcttaattggttctttccctgcacttacccgaaaaataattgtgttagcagcaggcttaacaatcgtaccttttttgtggttttgtctgataatctgtcccttatcgatatcatccgaatacactggttcttgatgaacttgaaatcccttgcgacgaaggttagccgccactgaagaatagtcatcaccaacataatcagccatttgcaattgcttaactcctgtactaaccgttagattaatcggggtactgacacgggtcttatggctgacgtcaggattggttgaaacaattcggtttttatccactgcctggctatttaccagagtaatcttaccaatccgcaagttttgctggtgcaatcgttgctctgccttttgtaccgtcattccttctacatcggggatgattacttgacggatcaagaaccaccaactgcagactgcaatcagcacaatcataccaagcgtcccgctaacaatcccatattttttccacttttgcggtttagttgatggatcaacggttggtgaatcagttgacttctttggttgataatcatcagcttttaggtgtttaatatctaacaccttagtttctccattatcatcttgttggatctttaaccgcggctcattagctctttctggatcaaggacggttttcaaatcagccgccatttcattaactgaactataccgctcagctggttcctttgcagtcgctttaatgattacgttttcgagtgcttgaggaatttctttgttctgttcacgaacagaaggaatttcttcacggaaatgcttcaaggcaattgagacagccgtttctccctcaaatggaacctttccagttagaagttcaaacaagataattcctagtgaatagatatctgattgtttagtagcaatgcttcctcgcgcttgttctggggataggtagtgaactgaccccatcaaggtattagtctgcgttaatgagtcttgcgatacagcaacagcaattccaaaatcagtaattttaacgtttttattttcatcaattaagatattttgtggttttaagtcccggtggataatcccatgcgcatgggcagtcgcaactgctgaaagcacctgttccataatatcaataacttgtggaagtggaatcggatagtgcttttttatatatgctttaaggtctgtcccctttacatattgcattaccatgtattgcaagccatgatcctcaccaacgtcataaattccaacaatatgaggatcatttaactgcgtcgcggccattgcttcccggtgaaatcgccgtttagtacttggatcgtcccgtaagtcaagacgcaatagtttaacagaaacgtcccgatcaagaaccatatcatgtgccaagtagacattagccattccaccttcacccagtgaccgaattatccgatatcggtgaccaatttcatatccaggattcatttcctatccctcctggttactattaatcccaattaaaacggtaatattatctggtccgccggcatcatttgccatttttataagttgagcacatttctcttcaagcggtatcggcaattcaagcaccttgataatctgctccttagaaacagtcttaaacaagccatcagaacacattaacagttgatcaccctcgtttaattcaaagcggtttacatcaacttgtgcatcaggagagattccaattgcccttgtaattatattgctctggggtagctttagtgcttcatcttctgatatatctcccgtttttaccaattcattaaccaatgaatggtctactgtaatctgcgttaataggttttgatgaaggatatatcctcgactatcaccaatattagcaaccacaaccgcatccttaaatgtaatagtggcgaccattgttgttcccatcccctgcaagcgaagattacgtttggattgcgctaagattttattattgattaattgggtttcacgagcaaaccaacggatcccctccattgatgtctgcgggggccgttttttaaactgactccccaaagtcgcaactgtttgctctgcagcgatatctccgctacgattgccgccaattccatcagcaataaccattaattgattgcctagcttgttagtaaacacagcaacccggtcttgattttgctttcgttggtggccgatatctgtttgataagcagctttcattaacttattatattcccttcttaaggctactgatgaagaagccatcagaatcaaagtcactcggtaatatagttaaggttggtgagtgacgattatccttaacttttcgtgcagttgttgtttttactaactcaaactccggatgttcagctagaaacgcttgaacagtatcatcattttcttgtcgtaaaattgtgcacgtgctgtatgtgattataccgccttttttaacttttgcggcaaccgcatttaaaattgctaactgaatcttatgtaattgcttgctatcatttagcgtctttgtataacgaatttctggcttccggcgtaaaagtccgatcccactacaaggtgcgtcaactaaaatcttatcgaaactttcatcatcaaaaagttgatcaacctcccgtgcatcaagggcatgagcggtaactcgcttttcaacccctagtcgacgagcatttttttcgatcaatctaaccttgtgttggtgaatatcaagcgcatcaacgtgaccgtcttcatcagcgagagtttctgctatttgaacagtcttcccaccaggagctgcacaagcgtccaggactttatcccccggttcaatatgcatgctttccacggctaacatggcactttcatcttgaatagtgatttcgccatttttgaagagatcggaactgataatttcacctttcgtaattactaaggcattttgcgcaacttggccttcttgatattcaattccagcagcatccaaagtttgtttgacggtcggaaggtcagttttggcggtgttaacccgaattacttgatgagctggctcattaattgattggagtattttttcagtatcttcttcgccatattccccagtcagctcattgactagccaccgtggcacactgttttcgatacttaaccgcaaatcacgttcattaatttgtcgcaggtcaggtaatcctttccgcaaaatggcatgtaaaacaccagtgacaaactttcgaatacctggatttcctcggcgtttagctatttcaatactttcgtcagttaccgcccaatctgggactcgttctaaataatggtactggtaaagtgcagacaaaagaagcgtctttacccaaggatcaagccgttttccctggataaacccattcagccaatattcgagggtaagtttatgctgcaaaacaccataaataatattggttgccaaccggcgatctttatctgccaacgggtacttttttaataactggtcaacctgcaagtttgagtatgcaccattttcgacaaccccttcaagcgccactaaagctaattcacgcgcattttgcggttgaaatttagtcttcacttacaacttggcctccctctgtaatatctttatgtccattaaggtaggatgtaatgtccatcgcctttttccctgctggctttaacttattaatctggtatgtcgttccatctccagcagcaattactaattgatgtttcgtgacccgcactacttttcctggttcaaggtctgttttttcttctaatggggtcacatcgtaaatttttgtacgtaatccatcaataaccatgttaccaagaggagccggccgtaatccccgcaccttcgcatcaattaaatgtgctggaaggcggaaatcaatctgttcttgttcactagtaatattgggagaaaagactacgttatccggatcttgagcgaccggattaacatccccgctaataagtttaggcaacgtttctaacagcaagtctcttcctagtaaactaagcttcttaaacatcgtgccactatcatcagtgtcttcaatcggaatagacctttgtgaaataatatctcccgcatccatcttcttaaccatgtacataatggagaccccggtttctttgtcaccattaatgatggaatattgaattggagcccctccacgatattttggcagtaatgaaccgtgaacattgattgccgcaattttagcagccgccaataactttgttggaaggaattgcccataagcagcagtaatcattaagtcaggctgtaaactaataattttctccatttcaggacttttgctgagtttagccggctgtaagacttcgatattatattgttcagctaactctttaactggcgattgatgaagagtacgtttccggccgatatggtggtctggctgggtaagaactgcttgaacatcgtattctggattatcaattaaactttgtaaaatcggaacagcaaactccggtgttcccataaaaacgactgatgttgacattaataacatcctttcttttacataaaatactgtggatctggatcgatgcttacttggacatccttaaaaccgcgactttgcgtatcctgaagaatatcaaacaatagctgatgcaaatacggatccttcttatatttgatgacaatttggtaatagtaacgacgcttcattcgggcaatcgctcgcggggtggggccaagaataaccgtcgaagataataatccctgctttaggcggccataaatatctgccattgcccgagctgctttggcttcttcaggatgactagccatcaaacgaacggtgtaatagtatggcggataactggcttgtcttcgcagcatcatttcctggttaaagaatttttcgtaatcatgtgttttggcatcttgaatagcgtaatgatcggggttatatgtctggataataacttttccttgcttatttgcccgaccagcccgaccactaacttgacttagcaaatcaaaagtccgttcactagcacgaaaatctggtaagcctagaccagtatcagcatttaagactcctactaaggtaacattagggaaatcaagcccctttgcaatcatctgggttcctaataaaatatccgcttggtgttgaccgaactgtcgcaataattttgcatgcattcccttccgccgagtggtatcaacatccatgcgaataatccgggcttggggtaataattgatgcaattcttgctcaactttctctgttccggtcccatagtagcgaatctgatggctatggcaattgggacattcacgggggattggttcttcatgaccacaatagtgacatttcattgtccgcgtatccatgtgaagtgtcaaagaaatatcacaattcggacactttaagacatttccacaatcacgacacatcataaaggacgaaaatccccgtcgatttagcattaaaatactttgttcgttcttttgcaggcggtcatttaagtcggttaatagtttctgcgaaaagttactctccccgtattttttaatttcatcccgcatatcaaccacttcaattggcggcaattcctgtttatttacccggtgcggaagacgcaacaagtgataaacgttttttactgctcgcgcacgactctccagactaggagtagcagaaccaaggactacaggcgcttgattatatttcccccgccatttagctacttcacgcgcttgataacggggtgattcatcttgtttataactagattcatgctcttcatcaagaatgattagccctaaattggtcaatggagcaaagactgctgaacgggcacccacaactacttgcgcttctcctcgctcaatccgccgccattcatcataccgttccccgtttgataaactactatgtaaaacagcaaccttggaaccaaatcgtcgccgcacacggttaacaatctggggagttaatgaaatctcaggtacaagcattaatgctgtctttccctgttgaagagcattagcaatcgattgcaagtatacttctgtcttgccactccccgtaactccttgtaagaggaaaactttagggtcatgattgtcgattgcttgattaatctggttaacggcattttgttgatcggcgttgagctgcaggggggctgctaaatgagcatcatcaggagtgacctgcatagccaagggttgtcgatatacttcaactggtgttttctctaaccatcccttctgttgtccctgattgaaggtggctgcttttaaaccagttttatgttcagcatccttttgcttaacaacttgactgccaattgattgtaaatatgaaagaaggcggttttgagcatgcgcattggcatgaagggatgcgcgctcatcttccagttgttcaaagttaagtaaagagcgaataccagtcaccgttttagccttggcccggtcttccacttggtattcaatcgctatctttccttccttttgcagtttgaacaattcacttaaaattgccggtttatcttgtaccgccgccatctctaattcatctcgaccatgaaaaatatcaaaggcaacatgttcgtctacttcatctataattcgaataattctggtagtcttagccttcaataagttaggcaacatcgtatataagcaagaaatccaaaaagaataagtagtatcagccaaccatttgctaagattcattaattcaggattaattaccggttgaagatccattatcgcctgaattggtttaagttctccctcatattgggatgcattgtcaagggcaacaacgaatccttgaacagtccgttttccctttccaaaaggcacaatcactcttaccccgacctggatttgtttttcaagctttggcggaatctgataagtatatggttggtttgtttgcattgttggaacgtcaacaactacctgtgccaactctggcatttaatcacctgactttaattttgcactaactagttcaataatctcgtttgcaattttagctttagattgccgggctaatttaattggcgtttgatctttttgtaagatggtcacttgattctggtcactgccaaatgcccctgtctcccctgccacgctgtttgcaataatcatatccgcatttttgctagcaagtttacggttagcattttccaagagatcatttgtctccgctgcaaacccaacgacgtattgaccggtttgcttcatcttcgcaatattctttaaaatatcaatcgtttcagtaagcgtaatggtaagatgcgggtcaccatcttttttcttaatcttatgaccaactgtttcaactggtcgataatcagcaaccgcggccgccatgattaaaatgtctgcttgcgaaaatcgttcttttaaactgatgtataaatcttcagttgtggttacgcgcacaacttcaatcgctggtgtttgtggaagcgagacggtaacttgaccggcaatcaaggttaccttagctcctgcttgaaccgcggcgttggcaagtgcaatccccattttaccagaggaccgattaccaataaaacgaacaggatcaatattttcacgtgttccgccagcagtaacaatcacgtgcttgccctttaaagcttgactgctagttaaaaagtcctctatatattggcagattgctgctggctctggtaaacgcccgcggccagcatatccttcagctaatcttccgctaactggcggcataatattgaccccgtcttgtttaagttgagtaatgtttcgttgagttgcgggggccaaccacatatggctattcattgctggaactacaattttaggagcactagttgctaataaggtggtagaaacagcatcatcagccagtcctgttgccattttagcgatgatatttgctgatgctggtaccactactgctagttctgaccaatcagctaactcaatatgaggaataggcgttgaatgctcatcccataggtcagtaagaactggtgctttcgtcaaggcaaaaggagtagcaggagtgactaacttagtagcggcgtcagtcattcctacgcgaacctcatgtcccattttttgcagcccacgcactacttcgattcccttgtaagcagcgatactgcctgtaagatacactgcaattcgtgtcattatgtcacctcaacttattttttcttaattgattatagcatttttagaagcaaaaaaggggccagtgacaatcctgccctagtcccttacttttgtttatccagcttattttaatcctgtaagtcttcagtatgatcaggatcgatcgtaacttttccagccaaaatctcttcaagggccttcccaactgatttgcttgaatcataatgttcaagtaatggggcagctcctgcatctaattcattggcacgcttactagcaagcataactaatgaataacgagaatcaatatgttttaataattcatcaactgatggaaaaaggatcatttttcggcatctcctaacatttcaagataacgtggcattacacgggtaacacgaagccgttcagtacgaataatgtctttaatcttttcaactgcatttggtacttcgtcattaactactgcataatcatagttttgcatcatttgaatttcaccaaatgctttatgaattcgtttattaatgacttccatactatcagttccccggtgaatcaatcgttgctttaattcatccaaatcaggaggggttaagaaaataaacacgccatctgggcacttagaccgtacttgcattgctccgttaacttcaatctcaaggaaaacatctttccctgaatctaaggtctcattaacatattttaatggggtaccgtaatagttgtcaacatacttagcatattccaacatcccaccagtttgaatttggtgttcaaactcttctttgcttacgaagaaataatcaacaccattaacttctccaggacgtggtttccgagttgtcatcgaaattgaatattgaaaatcattatcatttgaatcaaagatagcttttcgaacagtccccttcccaaccccggaaggacctgaaagaacaattaacattccacgatttgccattataacgctcctatttatttaatcgtattaatactataatgcactagattagtactgaaatcaagcatctgaataacaaaaaattattgagctttttgcttgcatttctgaatgtatgttcgtatactataatcaaacaaatgttcggaggcgcgattatgcaaattgaacaaaagtctatttttaaatttacgccacaaattattagtaagaaacttcgccatatttttgaagaaacacctgctgacgatcagcaagcagggttgcttactccccaacctgctaaacaacgacaattatttttaaaacgagctattaaagataagattaaagcaacgtttcagctaatgccgatcaacaatgatggctatccggtaaatgttactggtaatattgcccaattagcaaatagcaatcgataccttattacgaatcaaaatgtgagttacgttgttaactttgatcagattagatacattgcgaatttataatattggatttaaagagagtggaaaataacctcctcgacaaggcggttggctaagctaggacgatgattagcacggcacgggctgattatcgttcgtacttagactcgagccttgtggttattttccacgttatctttctattgctcataaaagtagtggaggatgagagaaaacaaaagttttttctcatcctctactcatttacggaatagtagcaagataacgtggaactagcttcgcgtcgttacaaggttttccccacttctctctcccttttattttgccatattaagcaattcttgcgcatgctcttttgtcaattgggtaatcttttcacccgatagcattcgcgcaagttcttcaacccgatcgttttctttcaatggcgtaactcgagtagttgtccggtcatcatggacagatttcttaataaggaaatggtgttgcgcaacggctgctacttgtggcaggtgcgtgatacataaaacctgtgaatgttgagcaattaagcgaatcttatcagcaattgcttgggcaacccgtccgctcaccccagtatcaacttcatcaaaaatgatactagtaacgccttccttttgcgcaaaaattgtctttagggctaacattacccgtgacaattcaccaccagaagcaatttttgctaatggtcccatcgattctcccggattagttcggatataaaattcaacctggtcaattcccgtcggtgtaaattgttcccgactttgattagcaaagcgaacttcaaattctgctttttccatgtaaagctctttaagctgctggtgaacctttttaccaagttcatgagcagctttttgtcttacctgactcaatttacgaccggtctctcgaatcttattttcagcttctcctaaccgttgctctaggtcactgctagaatcagccgcggcctccatcgaatcgagttcttttttgatcttatcataatacttcaaaacatctgccaatgtatcgccatatttatgttcaagatcaccgatagtagttaaccgttgttcaatctgagctaaccgttcatcatcaaattcaagcatatctaattgttgactagcttcattcgctacatcttgaagagcgtaataagcatcattaagtgccttactaagattatcataagcatcatcaaattcagcaattgcattgattgagtccatcaccgtggcaacttgatctaaaacaggcgcttgctcaccttcattaaaggtcgtcacagctagttgaagagcattattaatttgttgaaagtgttccaatcgatcacgttcactaattaattcatcttcttcattttcttttagattagcttctgcaatttcattaacttggtaccgaagcatatccaatcgctgcgcccattgttgttcatttgcttgttttttatttacagcagctttgagtttagaataagcttgatattcttcttgatatttttgaagtaaaggctgaacctctttagccgcaaattggtcgagcattcctaaatgagtctcaggttgcattaattgttgatgttcattttgcccttgaatatcaactaatcccgcaccaatttgacgaagagttgccgtgttaatcagttgcccattgatccggataatattacgaccattacgatgaatttcccgagagacaattaagattccatcttcatggtcaattcctagcgattcaagtagattatcaaattcaggatcatcaggaatcgcaaattgcccttgaagacttaatttttcttctccacggcgaataaattcctgcgacccacgaccaccggccaacaacccgactgcatcaataataattgactttccggcaccagtttcccccgttagaacagtcatttggtcagcaaaagttaaggttaagtgcttaataattgctaaattatcaatcgtcaattcttgtaacaaaaattttcacctcgcctagtcgagcattgcattaagcttttcttctaatttaattgctgcttctggagacatacaaactacaaggacatttccatcatcaccaattgttgtgaaaaccgttggaaaatccattttgcgaattaaggtagctactaccgggccattcccgggatgaaccgttaacgctaagaaacagtcattacgttttaattgttccaaactgtcttgaagggtttgtgctaattggttttcatgtccttggtgatgatatgctggcaagccataacgatagcccccattatcagcaggaatctttatcagttgcatttctttaatgtcgcgcgaaatagtcgcttgagtaactgtcaatcccatttcacgcagatgcgcaacaagatcttcttgccgctcaatgctctcattagtaatgatttcccgaattttttgttgtcgttctgcttttttcatggattaagtcacctttatttattccttatgattcaaatcatcatccgcggctgcaataaccttatcgatatttactttttcggcaacgatccccggattctcacttaggcgtaggtgaactaaaaattccatatttccttgtccccctttgattggtgaatagtctaatccaaggatgtcgaaatgatcttcacgggcaaaagtcagtacttcttccaaaacggcccggtgaactttatgatcatgaatgatcccatttttgccaacatgctctttgcccgcttcgaattgcggcttaatcagcgctactacttcaccacccattttcagtatctgtgccaatggtggtaagatcaaacgaagggaaatgaacgaaacatcaatcgaagcaaattctggttgaccactggtaaaatctgctaacttgctgtaacgaaaattggtctgctccataacaactacccggggatcctcccgtaattgccaaactaactgattagttccgacatcaagagcgtaacttaacttcgccccattttgtaacattacatcagtaaagccaccagttgatgaaccaatatctaaaaccgtcttgtccttaactgaaatatcaaaaacctttaatgctttcgctaacttcaagccaccccgactaacgtacggcattttatgacctttcatgtgaagggttgtggtaatcggaatcttttgtcctggtttatctaatcgttcattatttttgccaagaatttctcctgccatcactgcccgctttgcctgttcgcgagagtcaaacagcccttgttggactaacaatacatctacacgttcttttttcataatccctttccttatttaaaatatgctaaaaagtcatcataaccagcaaacgacttgccagtaagcttttcaagattcttttgattttggccagcagccgctaaagctatctgtagctgctcctttgcgccatctacaccgagcaatcctggataagtatttttttgctcatcagcatctttgtgaacagcttttcccatctcttcagtagtactgaggacatccattaaatcatcatagatttgaaatgctaacccgtagttttcaccaaatgctgctagctcttgtttgatttcagcagattgatccatcataatcccacctgccaaaacagcatagcgaatcaattcccccgttttttgacggtgcaagtatctcaattggtttaaagttagatgttggtgttcaccttcaatatcccgcgcctgaccagcaaccattccagatggtcccgcggcttttgcaagttcaagggttaattggctccgaatattagctggaaggtgattatcggcaacccactgaaaggccatcgtcaataatccatctcctgctaaagttgccatgcccgctccaaatttacagtgattagttggttttccgcggcgtagatcatcattatccatcgctggaaggtcatcgtggattaatgaatatgtatgaagcaattccaatgcagaagccgcacgtagcagatcatcattaagcgtgccacccagcatctcaatcgttgcaagcgtcaatgctggacgcagccgtttgcccccagccattagggaataattcatggcatcccttaaagttgcctgatcaacatctgcggccagtgacttgctgagatagttttcaatctgttcttttaaaatcggcaatggtgtactcatctttttctgctccgttgcttattgttcatcagcgctaccaaatccacggttaccaccgccattgttgcttgggtcatcggtttgcttttcgtagactttttcatcgccattatcgtcaattaagtgaccaagcgttttttcagcatttgttagcttcgtttgtaattctttagaaagcttgattccttcttgaaactgttgaagggcttcttctagtggcacattcccctgttcaaggtgattaacgatctgttgtaattgtgctaattgttcttcaaatgttggttttgctgttgccatcttagtgctcctttaccttttttatttctgcttgaacttccccgtcatcaaaatgcaggtgaacattttgcccaaccgttaattgactggcatgattaacaaccttttcatcactcgttacatacgtatatccccgactcataattttaaggggactcagtgaatctaattgtttaataagagttgtcacttgttgtttcttttcattttggctggcaagtgaggctgtaaccaattgtttttttaattgatcaactaactgttcttgttgttgaacccgatgcagtggagaagccgccgttaaacgcccacttaatctttccacgttcatttgtagctcttgcattttattttgcgctgcttgacctaactgttgagttaattggtcaaccttttgcgcataattttcatataatcttgtcggttgctgaaaaatatagctttgcagctgtttattcaattgttggcggtcaaaattaattttagtccgcatcgtatttaataaacgattctgatcatctttaagtgtcattaatgcatcgtttagttttaccggcgttgctaattcagcagcagcagttggggttgctgcgcgttgatcagctacgaggtcggcaattgttgtatctgtctcgtgaccaactgatgaaattaccggaattttgctattggcaattgcacgggcaactacttcttcattaaaaggccataagtcttccattgatcccccacctcgaccgataataagggtatcaaagtcgccgcggtcattggcacggttaatttgtctagcaatatccgccgctgccttatctccttgaacaacagtaggatatagaacaacttgagcaattggataacggcgtcgaacagtcgtattaatatcccggataactgccccatcaatactagtaacaactgcaattcgttttggaaacattgggatctgttttttaggtaaattaaatagaccttcagcgctcaatttcttttttagttgttcaaacgctaagtataaagagcccagaccatctggctccatccgatcaatataaatctggtagcgaccacttttttcatacaagcttacatgaccgactacacaaactttcatcccctgttcaggagtaaatttaattttccggaattgatgctcaaacattacagcatcgatcacagcattatcgtcttttaaactaaaatactgatgcttttgccgtaaacgaaaattagaaagctcaccggttaaataaaccgtatgtaggtatggatcccggtcaaacttcattttcaaatacttagttaattcactaactgttaaatactggcttctatccatgatgcctccaccacgctaaatcaactgtttgttccattaatgttgcaattgtcattggtcctacgccacctggaacaggagtgattgcctgagcttttgtctttaccgcttcaaaatcaacatcccctgtcaatttaccattgcttaaacgattaattcccacatcaattaccactgctcctggttttacatctgtcgccttgataaggttaggcacaccagtagcaacaattaaaatatccgctgttttcgttaaagcagaaaggtcgccagtacttcttccagccattgttacagttgcgttagcattatttaaaagagctaaaagaggtttaccaactaaaatactccgaccaacgataactgcatttttcccttgtaaatcaatattatattctgccaacatccgcataattccgcgaggtgtacaagccacgggataattaccatgttgattggcaaatagttttcctaggtttaggggattaaggccatcaacatccttagttggcaatatagcattggtgattacttctggatccaattgaggaggaaggggttgttgaacaagaatggcatcaattgtgtcatcatgattcagcttttcaatttcggcaagcagctcagcttgactaacatcagcaggaaatttttttaaaactgaattgattcctaacttaatagccttattatgcttatttcgggtatagattaagctcgctacatcatcaccagcaatcacgactgcaattcccgggattatattttgtttttcttttaactgtgctactagttctttcgtctgggagttgatttttttagcaagggccttgccatcaataattgtcgtcacagtgattcctcctcgttaaatttccattttatattctaccataataatattgcgcttaagcaaaaaaggagtggaatcagaagtttatcacttcattttccaccccataattattgttaacagtaatattaattattttcgttgacttgtttttcaaatttaccaagggctccattgataaatttacgtgacttatcactactgaatgttttcgtaagttccaatgcttcattaattgctactactgttggaacattttcagcgtattgaatttcaaatagagcaagccgtaaaatcactaaatctggctttgctaaacggttaatcgtccatccgcttgccaggagatcattgatttgttcgtcaagctgatcttgatgttcccgcaccccatttaccaaagttagtaaataaggcggaatttgcttttcatcatgatgaggaatcgcctcatatacggtttgaatatcagcttcagaatctgattgcaaagcaaagagaacttggaaagcctcctcacgaatcatgtgtcggttcaaactcattttattcaccagcctcgtcgttaagatgttcgccaaacaagtcattagggtctacttgttggtcttctttagatgttacgattcccttaatatgaacattaacttcttttacttttaagtcagtcattaatgtgatttgttgtttaaccttatcttgaatcattgccgctactttaggaacagagacaccatattcaacataaacatccacatcaagtgataatttttcatcattgctggaaagctttaccccacgccggcgatcagagcgtcccaaaagttcacttacgctatttgcaaatgaaccatacatctttgaaacaccatcgatttcacttgcggcaatccccgcaataatttctaaaactcgtggcgaaatttgaattgtcccgagtgacttgtcttcactacttaaaacaatctttgattcttcagccatcgtcagccctccaatttatttcttctcttaattatagtaatcatttctattctgcactatgttcgaacaaattgcaacaacttggtcaattaggaacctagcgacagtatagaaattaaccgcgacttatgattataccaatcatgaacgactaaatcgagactagatgtggtaaattgcccgaaattaattgatttaaatccttctaacgtcttcaagaaacggtctgcctgctgaataggactagtataccgtgcaaccgtcacatgtcctgaaattgttggatatcgttcttttagcaacaagtcatgtaacggcagttctttcctaagtgtgttccgtaaagttgataattctgctgaataatacccttttacaagaagcgctcctgaactagtgatcattcctgctaaacgccagtgaatcggtccaatttgtgaaataatctgccctactacgtttttatatttttcctcttcaaatgttgagagcaaaaagtctgagctagctgcaataaggtcaataatcgtaatatgcaggtcagcaggaggatagaagtattggttaggttcaattgcagccaatttttgcaggcaaaacataatattgcggctaacatgcgcaggaagtgaagcagtaagcgtcagtcctcgccgcatatctttatcaggatttagcaagttacgatctagctgttcttgatgatttctaattgccgtcattccctgttgattaatattattatacagactagtaagttgcatactattttcctacgattattaggtcagttggcgccttcgtcagcacttcaactccaccgtgagtaaccagaatatcatcttctatccggaccccgccaatttcaggaatatagataccaggttcaacagtgataacttcattgttccgcaatttaatattttgagcacttggtccatagctagcaggcaattcatgaaccgataagcctattccatgtcccattccatggttgaattcatccccataacctgctatttcgattaattgccgtcccgcaaagtcaagttgatcaccttgttgcccaacatgagcagcttgaattacagcttcacgcgcctcattgacaatttgataaacatcacgtaattctggatcaattgaaccaacggcaaatgttctagtcatgtctgccgtatagccattgaagtagtagccaaaatcaacagtaacaatatcgccgtcttcaatcaccttttttgaagccgtagcatgcggtttggccgcatttttgccactagcgacaattgtcggaaaagaggccccgctcgctccatgttccttcatccaaaaatcaagtaagttcgcaacatggcgctcggtcatcccagcgtgaacattttctaaaaggtactggtatcctgctgaatgtaagtctgcagaagcccgcaaagcatttacttcatcactatctttaatcattcgcatccgttcaagttgttggtggaagggaacaagatctgctgtcatctgctcatcaagcacatcaaataaggcgtaagtaactgtatcttcatatccaagaaccgtcactttcatcccctgacatattttattaagtgaaccgtaatagtcacgggtaatcattcccacaacttcatcattttcaaattcttctaatgcaagttggtaccggtcatcagtaataataatcgcattatcttttgttactaagaggcatccatcgcctctcataaggttaaaaccagtaaggtaataaatgtttttttcatccgttactaaaaatgcatcgatatataatttttcaaatttcttctgtagacgtttaattctagacatagcacatttcctttaatactgccggttagagtaatcacgagggccaaagatagctgtcccaacccgcacacaggttgaaccttcttctaccgctatttcataatcatgggtcatccccatactaagaacatctaattttaattgatcattttggttgttcatttcatcgcgcaattcacgtaggcggcgaaaaatcggccgtgttttttctgggtcatcataatagggagcactagtcattaatccccgcaactttacatgtggcaattgaagacttgcctcagctaattccatgcaatcttgcaaagttggcttaaccccaaatttactctcttcttctccaacattaacttcaattaaaatcggaattattcgatcgtgctttctcccttctttttcgatcgtattcattagtttaagggagtcaaccgattgaatcattgtaacgtaatcagcaatgtatttaaccttattacgttgaaggtggccaatcatataccagttaatgtctgctggtaattcatcatgctttttggctaattcctgaacataattctcgccaaaattgttccatcctgctttgtaaagttctgcaatatctgctgccggatgatttttgctaactggtaacagttgaacgtcttggggatctcgaccgcttcgcttgcatgcagcaataattttttcttggacttctttagctttatcaacaatcgtcattaaacattatgctcccttcaattgtaggttaattatattcttacattatagattaacatatatgaaaaattattttaaaaataaaaagactactatttcatgtagaaaagtagtcttttttataattattcggcaactgggtaaactgataccttacgcttactgcggcccatgcgttcaaatttaacaacaccggctaccttagcgtataatgtatcgtctccaccacgacccacgttttcacctgggttgatgtgagtaccacgttgacggtagatgattgatccagcagttacgattgaaccatcagcagccttagtaccaagacgacgaccagctgagttccgaccgttagcagtggaaccaccccccttgtggtgggagaagaattgcaaatccataatcatagttgttcacctccagcaatgaactttaatcaaacatttttacttcaatgttttgtggatagctttcctggatatcacataatccatttaacaaagttttgagaaggatctgactatcatgaccaaggtctaatcctgtaacttctaaaaagccaccattatcattatcttgtttaaggtgaggctttgtatgaacaacttgttcaagcccgttcaccgttgaaatagataatgcagaaactgcggcacaaacaatatcctgcccatatggaccagagtcagcatgcccagtcattttaaaagaagtgatccgctgattcgaatctaaagtaaactgtgctcgaatcatgatctcacctccacattaagcgttgatcttgttgatagtaaccttagtgtaaggttgacggtgaccttgcttagtgtgagtgtgcttcttaggcttgtacttgaaggtaacaaccttcttttccttaccttgcttatcaacagtaccttcaacagaagcaccgtcaactacaggagtaccgatcttagtgtcgtctccaccgacaaagataacttgatcgaaagttaccttgtcaccttccttagcatcaagcttttcaacgtagatagaagcaccttcttctaccttgtattgcttaccaccagtaacgataattgcgtacatactttgtgcacctccttaatatctcagactcgccgtactaagcagctaaataagctttagacttaataacgtgcggttgtagttgttggttcacaaatacaacgtttgtataatatcaaatattattctcttcgtcaaccataatctctactttatataacgaaaaaagaccttgaaaaaagttttttcaaagcctcttttcttatagtagctattaaatcttttctaaagttccttctaattcaccatcaaaaaaattaaccaaagaaacattctcgctactaaactgatccaacatctttgccacgctttgtgtcatgtaacgtggagtataaatcatgccatcttctagccatcgacttactaggccaagaaatgctgagtcaataaaggaaatctgcaaattaagcgggactttcaactgttggttcttattcacttgctcattaaagtgtgtcatctcatttgctaaccgattgtagagttgttcataaaagaagttattcttttcattatttaatagaacatcaaaaatatcggcgttattttcgatatactgaaatgctttgcggagtgaaaacacctttaccgtccgttctttcgaaaaattactatcgatcattacttggttgaagaaatcgtcaataatctcttggattgctgactgaataaaatcttgtttatccttatagtgaagatagaaagttcctcgggtgatgttggcagtttcagtaatcttttggacgctaatatcttcaagcttttcacgtctcatcagatatacaagagctttgcgcagactattacgtgttttaattacacgcgggtctgtcttattagcagccatttaatcatcatccttccatcatacagcttaagtcctttctactttcgtacttctactatatttaaagtatagttgtcatgaaagcgttttgtcaacgaaagtgccgactttatcttaataaaataattatatcagattattaccattgacaactttgtagtgaaaattatatacttaaatctgtttggagcggtagctcaactggatagagcatcggtcttctaaaccgagggttgcgagttcaagtctcgctcgctccatataaacgttaaaaagaggatagagaaacatttctgtttccttatcctcttttttagttgtctcaatataaacttagggataattttctaattttccacttttattttttaagtatttcttaaatacgtcctcatatattacactttcgttgcaaaaataaacatttttaataataatgaatatagagattgctttttgaggtgattattatgctaccatttcttattattgttttaattttggttgcgtcggtaattggtgaatttatgtttggcagtcttagtaaccaagaaactggtaaacatagtacaactaccaatcgcttacgagatcgaaaagcttaatcttatattccgttcaacacgagaggccggggaaaaaattcctcgacctctcgcttttttattctaatattgattaatcattgcttgataagcactagaaatctgatcaggcgttaattgccaatcgctaattcccatttttaacaaaagatgccaagcatgccgaaaactttcttgttgatgattaaaataggcatcactcaagaaatgtttaattgctagatacgatttattaaggtctgctaactttgtagagctttttgcattcgtaatccgttgccaggcttgatcatcgagtacaaccaggtgtgtccattgcatctttgcactatacaataaaagtagcgctaccgattgaacatacgattttagcaaatcttctttgtctgcttctctaggattaactaccttataccaccctgctgcttcagccatatttgataaagaaatatcaaggtcaacaaaaattgtttgctttcttgtttctggcccaatcattaattccttttcatcatcaatctttaattctaaatcgataatttggtgaagcattttagtaatatctaacattgctgtgcctccacaataaaatccgttgcttattcttcctcatcaggagctggatcttctgatggttcagctgaagatgcttcatctaaagattcatcttctgctacctctgtcgttgctggtggttcttcatcaacaatctccatatgatctgttctcacggccagggcagaacggtttgctaaataccattcgcgaaccaggtcgtaatgaagcaatacatcaaagaatgaaacttgctcatcagaatctttaaccaagaaggcccactcttgactataatcatccggatcaaaagcaatgtcaagttttgtcccctgatctaatagtaactcagccccattgttccgtggcaaattcatcaacatataatcttcatcagcagtcgcaacaaataaacgatcaattactgtcagtggaagttcaggcttattcaacataaagcggcgatcatttgcagttgctaaaatgcctagatcaatcgtgaaatcaagatctttttgcaagtatttagcaaaatcaatcagaggtttaaccgcatcacgtaattcaaggtcagtatgctgtttaagcgcataaacgataaaataatttactaatgcacggttattaaattgcattaatttatcttctaaactcaggtagaaaagtgattcgtgctgactttgctctgtaaaagctgcttctcctcgactatcaacttcaaatttaaaaacagcttcactaccaatagccgcaacagtcgcttcaaattcatgatttaattcattttctgcaacgttaacagctgtatcaccatgcatttttaataggcgatccataaaaatcagataatagtcagctgctttataatgtggtggaaaatcaataaatgcattcgccaagtccaattttgctagtttattagtagctgataataaattcttagcatccttagtctgggctaactggtctaagaggtcaacatacctttgtccaagacttaaaacatccttaaatgaatcagaaagggcttgaacccgttcactaggagaagtcacgattcgattattgctcatcgtcgtccacctgctttccttctgatccatttaaactggctaaataattagcatataaattgcgattagctaattcgaaatcttcaaagctgccaaaaatatcgataatactcttttgttcataacttaaaatcgtattttcttttgataaggataggacaacgcgttcattatccttaatagtttgggctgcattacgagattcttcttcttggtcctctaacttttgcagctgctcaaccagttcctggcgactctccttgttacgacttgattcccaaatgccagaccgtgaactaatttcttttaattgttcttgaagggcttctttacgttcctcacgttctcgttgatgatcaatcaaatcttggagacggtcattttcactagagattttactaatccggtcactattgtaacgtttattgtcacgcgctaattcaaaagctgtccgtaatttatcatattctgtttggtcaaaagaaaagcggacatttaaaacgtctaactcaccaaattgacggcgatcccaccagttaccaaaataaatccgatagtggccagtttggtattcttcataataaaagaacggataagttttgcccaaatatttaattaagttttcactaaggtaattacttaattgatcggctaaatcatcgactaggttcattacacctttatcatttggttgttgttctcgatgttcaatctctttagcatagcgctggttatctagtaattggtagatttcccgatcacgatggtttgaaattgcatcattaaagcgtcgcaaatactttatctttgtaataatttgttgattgatgacttgagtaacatcaagtgaatcactattagtttctacactcgccataagcatgctccttgtctaaataactacctattataataaataactttactaccttttttccactctttttaaatttttttcaaaaactttatatttttagtacagatctgttttttgaaggtaaaaatagggactgtgacataagttaagttactttcataaaaagcaaatacgcagtacaacaatggcctccaacgtccggtttaaaaaccgaacgctggaggcctattgttgcttgcgggggctcccagaggctagctgcgcgtcgaaaaacgaagtcacaagtgacttctgtctcgctcccattcccttatccaattattaaatatcaatgaacccctaatgataatttagcaaagcggctcatccgatcaatcgtccaagcaggttcccagacaaattctacatcaacattttttacctctggaacctcttttaccgctttaatcaccatatcagccaatacatttgttaatgggcatcccattgtcgttagcgtcatttcaatcaaacatattccatcattatcgagatcaattgtataaacgagtcccaaattaacaatatcgatatgaagttcaggatcaataactgttgctaatcgttgaacaatatcgtccttaattgattgtttgtctctcataattaattgtttttccaatacttctcaataaattgttgtcggccaccagcttcttctaaggcaaaacgttgcggatctttcttataaaagccctgatgatagtcttctgcagggtagaaaggctgcacatcctcaattgttgttacaatctttgcatcgccaaaacggccgctttcctgtaaagcctttttcgatttctctgcaattttacgctgttcatcatttttaacgaaaattacaggacgataattatctccccgatcctggaattgaccacttgcatcagtcggatcagtttggtgccaataaatctctactaagtctttgtatgaaattttatcaggatcaaaagtaatctttactgcttctgtatggcctgttgttccagaacatacctgctcgtaggttggattggcaacatggccaccagtgtaacctgattcaactttctcaattcccggataagtatcaaacggctggaccatgcaccagaaacatccgcctgcaaatatcgctgtgtctaaactcatatatatcaaccctttcttaattacgaccatagattggccatgctgcttcttgtgcacccttatatgtcttgttaatagctttttcagtttgctctgtctgatatgcttttacaatctccttatatactttattatccttattcttttcttgaaccgcaataatattaacatatggttttgcagctttattaactggttcaagataaattgaatccttctttgggtttaactttgccgctactgcataatttccatttataattgaggcatcaaccgaatttaacgctcgcgcagtcgttgccggatcaacctctttaaattgtaaatgtttaggattacttacaatatcttttaaggatggcttaattccacttcctttctttactttaatcaagccagccgactgcaagacatttaaccctcgtccaagcgttgtgggttcattaggaattgcgatcgttgctccttccggaagatcttgaattttttgatacttgtgggaataaactcctaatggtgaaatcacagtatttccaattgatgttaagtgtgcgttttgctctctgttatatgattcaaaataataacgcgttaaacatgagtgcatgtcaattttaccttcctttaacgcaacgtctggttgaacataatcattgaaaacaacatactcaatattgattccttgtttcttcaatcttttacgaacattatcccagactggttccgaatctgttcctactaagcctaaacgaacagttttggttgaagttttatccaagcgttggtgaataatactaccaatcccaaccaccacaataattactaaaatactaaaaataatcaatcctgttcttctcttgcgtttcattttcttcctcctttgccagaaaagaaaaacgtccctaagaacaactcaatcatgttcttagggacgttaataacgtgttaccaccctgtcttcagtacaaaagtaccctccattctaatcccagcttgaaattagaagcatagataacggttgctaccccgtagaaaatttgcttttaagcaaagttcaccctctcaattaaccaaagaccatcttcattatttcgtttcctgccatttctcagctcctatggctctctgtattggtcgtaaaataattactcatcttttctaacgtaattttaatttatttttaattatactaacaacagacgctacataagtcaatatctttctagaagttttcctgtacacaattatgataattgcattttttatagactgaactataatattagtaacagttattttatttttgttaataactgttattgttgaagcgtttcagaaaaagaggcgaagttatttatggcacttagtaagcaagaacgtaaggaaatggctcgtaaagctatggaaaagcgtggcagcaagaagccagatggttctggttttgcaaagattgatgctgacgccaagaaactgagcgaataactcttttgaagcaattcacttatatatttaaagagacagagatgtattaacaccgctgtctcttttcttttaggcattattttttgcttgcttacaaaactctgcgagacggtccatccccgctttaatctgctcaagacttgtagcataactaaagcgaaggtatccttctccacccttaccaaagtttgatccagctgttacagcaaccttggcttcattggcaagttgataaattaacttattatcatcctgattaaggaatgacggaatcttggcaaaaatataaaatgcacccattggttgactacattcaaagcccatctctgtaagtcgcttatacatatagtcacgccgtttgatatattgagcatccatttcctttgttgcttcatccccaacctttagagcggcctctgcagcatcctgaacaaatgtggcgatatctgtcacagcaaatgcatgaaccttgaacagcagatcggtcactttagctggtgcacaaaggtagccaattcgccaaccagtcattgcataggacttagaaaatccatttgctaagattgtctggtctggcatgattttagccatgcttgaatattcaccgtcatagtttagttcactataaatttcatcacagattgcaaagattggcttgcccttaattaaggctgctaactcattcatttctgcttgagtataggcaattccagtcgggttagaaggattaacgaaaacaattccctttactcgatcaccatatttatctagataatgtttaagaagggcgggcgttagtttaaaaccagtcttggatgtatctacttctactggcgttcctccagcaatcattacatcaggcgtgtagattgaaaaagtaggcgttggaactaaaattatatctccgggattagtaatcgcagtaattgcaacagaaatcccttccgttacgccgtttgtaacaagaatctctgttgtaggatcatactgaaggccatatttattagccaatgtatcggcaattgcttgacgtaatcccactgtaccacgttggggagcatagtgcgttcgattgttttcaatgctctctattccggccttcttaatatattctggtgtatcaaaatcaggttcaccaattgtaaacttaataattcctggaatttttgaaacgtattgagaaaaatcaaatactttcaacgtcggaacatcatttaagatcttccgcatatgttcactcatttcaaccattttacttaagatcccctttttttactaactgcatatcttaattatatgacagtttaaaagaaaaagcatagaacaacatcgattaactgttgtcctatgctcaattttataaagttagttttcaaatgctttgatcatccggtcaagcaattcaatatctgtatcacgagaatagatatccatgatctcataaatttgtggtgcagacgttgaaccagtaaaggcaaggtttaatgggaagtataaaccgcgacccttaatgccagtgtccttacctacttccttaatagcttgactgtaatccaggtcatcgtcaccgttttcaagttttgcctttaagcccttgagaacagctaaaacatcttcattagcgaagtcttcgttgtccttaagcaagtcatagttgaatgattggtcaagaactgtatagtatgaccatgcatattgaataacttcaagaagcttattaacatcccgctggtgaaccttaattgtcttcttaagcaattcagtcaattgttcttctggaatactttgaaggcgcttagcttcttcggtttcgccttctttaattaattccattgtccgatcagttaattcatcaatcgacatactcttaatgtattgagcattcatccaatcaagtttcttttgatcgaagtaggctggtgcctttgacatccgctttggatcgtaaaccttaatcaactcttctttagagtaaatttcacgttcaccaactggagaccagcctaagaatgcgataaagttaaagattgcttcgtggaggtaaccgtgcttcttgtattcactaatgaattgaagggtatccttatcacgcttacttaacttcttgcgagtctttggattaaagatcaatggaatgtgacagaaagttgggtgttcccagcctaatgcttcatagatagcaatttgctttggtgtgtttgaaatgtgatcagcaccacgcaaaacatgggtaatgtccatagtgtggtcatcaactacgacggcaaaattgtacgttggcattccatcactcttttcaatgatgaagtcaccaccaaggttgtcagagttaaatgaaacatgaccacgtgcaatatcgtcccattcgtaatcatggtctttagggaagtggaaacgaatagttggcttcaagccctttgcttcagccgccttttgttcttcttcactcttaccataccaacgaccatcataatgaggtggttcattgttagccttttgccgttcacgcatctcggctaactcttcctctgttgagtaatccttgtatgcaatccccttgtctaacaattcttgaatgtatttgtggtaaataccttctttattccgttcactttgacggtaaggggcatactttggatttggcttatttggaccttcatcccagtcaattcctaaccagtgaagattttcacgttggctagcttcaccatcttcaacgttccgtttggtgtcggtatcttcaatccgtaataccatcgttccatcgaagtgacgtgcaaataaataattaaataatgctgattgagcatttccgatatgtaagaaacctgttgggctaggtgcataccgaactctgaccttttgatccattatctaagactctcctttagtaactaatcgaaatataattccgatttaaaattggttgctagatcaactagcagtcttaaaaaacgtactacacatattataataacacgcttttattgcaacaaatataattgtatatgaaacagcatatttgtcaattaactagttgatttcgtatgaaaaacacttagcaagtaatcctgcataagtgttttttcgttgtttattaacttattgttattgattagtattgttccatatagtgttgacgttcccagtcagaaacgtgttgacgatatgaagcatattcacgagtcttggcttccataaagctgttatagaggtgttcacccattgaactcttgataacctcatcgttagccaaagactttaatgcgttgtgtaaagtatctggtaaatcatgaatatctttttcagctcgttcggctttcgtcatcgtatagatgttttcatcaacgttatgaattggtggtaagttgttgcgtaaaccatctaaaccagcttcaagaacagcagcgattgcaagatatgggttagctgatggatctgctgaccgtaactcaagtcgtgttcccattccacgatcactcggaattcgcacaagtggtgaccggttagaagttgaccaagcaacataaaccggtgcttcataacctggaaccaatcgcttataagagttgacgattgggttgcaaattgcagtatagcttcgtgcatgcttcatcaaaccgcccaagaaatggtaagcagttgcggaaagcttatctttatcattttcatcaaagaaggcgttagtaccatcttgactaaacaatgacatgttgaggtgcattcctgaaccattaataccagaaagcggcttaggcataaaggtggcatggaagccatacttcttagcaattgttttaacaacaaacttaaatgtttggatgttatcagcggcttctaaagcatctgagtacttgaagtcaacttcatgctgaccaggagcaacttcatggtgagcagcttcaacatcgaagcccatcttttcaagagctaagacgatgtcacgacggcaatcttcaccaggatctgccggttccatgtcaaagtaattttccttatcgttaagattggtagttgggttacccttttcatcagtcttgaagaggaagaattctggctcaggtccaatgttaaagtctttgaagcccatcttccgcatatcttcaagaacccgctttaagttgttacgggggtcaccttcaaatggagtaccgtcagtcttgtaaacactgcagattacccgcgcaacctttccgtgttcagcaccccaagggaatgcaagccaagtggacatatctgggtaaagatacatgtcactttcttcaatccgaacaaatccatcaattgaagaaccgtcaaacataattttgttatccatcaatttatctaactgactaactggtaagtcaacgctcttaatcgttcctaataagtcagtaaacataactcgtaagaaatgaatatcttcatcctttaccatttggcgaacttcatcttttgtaaatacgtgtttacccataaaatttcattccctttcatacaatctccacagaaataatagatgaccataccaatctatctaagatctgcttctctccttaacactgtgacttagaataacaatagacaaggcataagtcaattctatttaagagctttattttaataaaaaaaatcttcccttccgtactttatttttttaaccaatcatttataaactgcttaatttgattaatatcatcgggatgacgcaaaatatcaaaccagtgagtatcagccttatttctaaaccacgtcaactgccttttagcataatggcgagaatcctgcttaattttttcaaccgcctcgtctaggctaatctcgccacgaaaataaggaaataattcatggtacccaatccctttacctgctggcaaatcttcccctccttgatcaaataaccattttgcttcttctaacaagccgttttgaatcatcaaatcgactcgcttattaatccggtcatataaaacaggacgatcagtagttaggccaatcaagagaaaatcatttgttgctttgaagtgtggctggttggaaaataattgacccgtttttttgattacctctaaagcccggataacccgacgagtattagacttggggatccgagcgctggccactggatccaacttgtttaattgttcccaaacatactcggctcccttttcttcagcaacctctttccaatggttacgaatgtcgagcgtttgttggtcaaactggtcacttcccaatgctaggttatccgttaatgtttgaagataaaatccagttccacctgcaatgatcggcaaatgattacgttgagctatttcgtctattttttggtcagcaagtttcttaaaacgggcggcagaaaaacgctcctcaatattgcagatatcaatgagatggtgcggcacatcccccatttcttcgggagtaacttttgccgtcccaatatcaaggcggcgataaacttgcatcgaatcaccggaaattacttccccatcaaattcatgtgccagttttattgatagcgcagtttttcctacagcggtcgggccgacaattgcaattactttattcatcttaactctccaatttttataaattttatgctaaaacttgtccttctcactggtaaaacaccattaattcttgcataatggaggtaacctataaattcgaggaggttttatgttatgaaacaattagcaaaaggtattttagttggtagtttagcaacagttgctgccattgctagcggggttcttactttccataaaactgtcattaagccagcggaagaagaagaagaaaagtttgatcaaaaccgtcgagctgctatccgtaagggccgctcagcacaccaactttaattttatttaagattcaaaaagcagagaggctggaagaaaactttgttttctcccagcctcttttttattggttaaatttcacaagaggctagattctaagcattagcaaataattggttagaatcatcaaccatcctgacaaaaagcatgtaagatacttttcttaatacttggacttcttagtcttaccgtcccacgcacgataaccatcttttaaaatataaaggtggttatacccatgcttacctaaaaatgcagcagcctgggtacttaatgtcattccttcatcatataagtaaaccggcaagtccttccgcaattcgccatattgttgacgaagatatggataaggcaagttacgtgcaccaagaatgtgaccttgtttaaagtcattttcttgtcgcaagtcaataacctgtgcttttcgcattccttgcttaaagtcatcttgactaaggacagttgcatatctctttcgacggtaagtctgaaatgcccagctaaaaatccatactaacaagatgattataatgactgtattaagaatcatcaagccagagctaactccaagtaccacgatcatttccccttacaaattaatctgcgtttacaaactgacgagctaatgaagcagcaccgataacaccagcatcattacctaattcagctaacttcaattgagttgaagtccgaactgttgggaaggcaaatttttcaaagttttgctttacccgcttcaaaaggaattcaccagctgcggaaactccaccaccgataacaaggtattcagggttcaatgcgttacttaagttggcagttgctaaaccgaggtagaagcaaacttcatcaacaacagtattagcaaggtagtcgttttccttagcaaggtcaaaaacaatcttggctgtaatttcgtcaccgttatcaatcattgccttcaaacgactgttaccttcatattcttccgctttatcttgagcgatatgaacaattccagtggcagatgcatattgttcaagacatccatggtttccacaagtacaaaggtatccatctggcttaacaatcatgtgaccaacttcaccaccagcaccaacgacaccgtggataagcttaccattggagataagtccaccaccaacaccggtacctaaagtaataaatgcaacatcgtcaccttcattaccagcacccttccaacgttcaccaagtgcggcaacgttagcatcgttatccagagcaaattgcatcccagtgccttgttcaatgtcttctttaacattttgcgttgtcttccagtttaagttgtaggcaccaataacagttcccttttcacggtcaattgttccgggagttcccattccgattccaataaattggtctcgagacattttgtataaatcaaggtggtgattaattgagttaatgatgtctggcacaatgtgtgaaccatcatccaaaatgttagtccgtaaagaccacttttgttgaatctcaccgttctccgttaaaattgcaaacttgatagtagtaccaccaaggtcaacaccaattaatttcttagccataatgattcctttcctgggtaaggtttaatacagtttaccccttttaattctcgtttgttcttcacgatgttctttacgcaaaacaatctttgcttttgtataagttgaattatctacaactcctgattgatagaggttatcaagctcaatggccattaactcaatatcatacaggcgcttaccaacatatacaaacacgttgaattcttttaatagttgctgaacatcgtatagtgtgcggtagtttcttgaggcgatcgccataaattatcacttcaattctagagtcaaaattaccaaacttaccgttaatacagctccacttaaaaactgttttaggtgatcaacagtttctagcatgggagcaccaacaataaatgcaatgaaaaagccaccaaaaaggccgccaatatgtcctatcaagtcaactcctgacaggaaaaaatccatcacaatattaataataacaaataacaaaaaagtacgacttaagacgcgaacaataacgttatggcgaaaacaaacgcctaacattaaaaatgcgccaaataatccaaaaatagcagtactagcaccagctgaaattgtcgatggcatgaagaccgcgctggtaaagttaccaaaaagcgcactgacaaagtatatgactaccattcgccaatgaccgaaaaattcttcaatataacggccgatatataaaagcgtaacgctattgactactaagtgtgataaaccaacatgaaggaacacaggtgatactaagcgccaccattcaccttccctgattaagggcgtactacgagcccccatattcaggagggttactgtattagttgagccacctgcataaactaaccagcaataaactaatacctgaaagattattaaggtaagcgtcacgggcgctaatcttagtccctgcgtccgcatcttctatatccccggtaaatacaacactttatctattcgctgatcgaattcttctggttcccattcgttctcttcagccagttgcgttgtcaatgccattgaaactttaggacccttatagttttttaggtaacgatcataataaccgccaccaaagcccaacctgttaccagatgcggtaaaggctactccaggaacaaccatcaaatcaatctcatctggagaataaactttgccatcatgtggctctaaaataccaaaagacgtctcgtcgaaatcggtatcctcatttaattcaacaaattccatttgacgatgaggcaacgtccgtggaataacaatctgttggcccttatgacgcgcatgaaggataataggtgcagtatcaatttcaaaagattgacttaaagtaacagcaattgtcttagcccctgtccattcaggttgatcatatagcaaagatgctaactttcgctcttcgtaaagacgggtgtttaaatctaattgttgaaggcgcgcaatatatgcttgtcgtaactctttctttgaataagccattatgttatgaccgctcctttatagtgaagtaacaaacggtatcagattttattatcgccgcttgagggaatttatgcaagcgtttttttataaaaataaataaaaagagccggtctcccagctcctttatatggtcattacttagtttcccgatgtaatgtaaccttttgttcccgtggacagtacttgtttaattcaagacgatctgggttgtgacgacggttcttgctagttaagtaagtccgttcgtggcatgaagtacattcaagtgtaatgttgacacgcattattttgacctccaaactatttcttttatttaacgtggttatttatcgtaaccctaactcgtacaactatatcatttattcttctatttggctagtaatttatcaaagtttgttaaggaaatttccttgacagtttaattagtcaccaaaacccttgggactctgaacagtcttccagtaggcctcaaaaatttgttttgccattgtcaggttggcaccaccatcggaatttgaagctcctggaatagccaaagcaactacaacttgtggattatcagatggcgcaaatccggcaaaacttagcgtagttgttgagtgcgacttgtagtaggtttcggcagtccctgtcttaccagatactgatggtttaacagatgccaacggtttaccagtaacataacggttagaaccatgaaccacttgataaagcccttgtttaacgacatcaaagtcagctttagaagcaggaatggttaattgaacttggggctttgttgtatattcaacggcaccaagttgaccattggctttcgtaccacggatttctttaacaatgtatggacgcatccggttaccaccgttagcaatggtagacatatattgggcaagttgaatcaaagtataaccatcatagttaccatatgacaagtcaagtgctgaaccgatatgcttttggtcagcaggtcctgtataaccgcttgtttcaccaggcaagtcgattccagttttaactccgagtccaaacatgttgaagtaaccccgcgctttagcaaaaatacttggcttcatcgtaatttgcgcattcggtgtatatttcattcctgcttctttcatgagtagttgcatcatataagagttggaagaaacttcgagggccgttgctgcattaattgccatatttgctgagccgccatggttaaaccatgatcccttagatgaagttccagcaagcttaattggcatatcggttaaggtattatttgttggcgtaattacaccatccattaatgcccccatgaccatcgccggctttacaacggaacccatcgtaattgggtggttgatagcaccaatttcatcaggggtttctttacctgtttctgggttacgatcaataccagccatcgcataaattgcaccggtatttggattcattactactgcatataccccagtagagtactggtttccggcagccgagtaattgtttttcaaaatcgattgaacttgcttttggaactttgaattaatcgtcaatacaaggttatcacccttcttaccagggtacttagtcttttctttagttacgtcatttccatcagtagtaacctcagtttgtgacttcgacccggctaaggttgattggaactgcttttcaagataactttgtccaacgctatcatttcgagaatatccttgagcaagcagtgagttaacttcatcacttggtaaaccagtagttgagacagttcctgttaacgattgaatatctgtgccttgtgggtaattacgagtccaagacgtgccgatctttacccctggcatttcattcaggtgttctccaactgctgcaagctctttagcactaacacctgtttctttaatataagttgtcgaaagggaatatgctccactcattgccgcataaattcgggcattattcttttgctgatcagtaagctcccatgaatcaggatgcttgctcaaatattcgagagctttatcatatttagtatcttcagaatcggcatctgaagtcttgacatgtttcaaaacactcttaagccgctctttatcagcaaggtaataatcctcttcatttcgatcagttaagcgtgaattcttattagagacagacacatattttcctaaacgattagcaatctgatagagctgatcagtagttacattggcccctttggtataggtaatggcttgatgagtttgattaccaacaagaacgttcccttgtgaatcataaatcatcccccgttgtacgttattcgtctgcgttgttgtatctgatcgctttacttccgctttaaatgatgttccttgcagaacttgaagataaaacagtcgaatagttaacgctaataacaagataccaacaatccatagtagcatgttcagccggaatggaataattgactgcgcattttgacgctttttggtacgtgaaccaaataagttcattattcgatcaaagaatttcacagttttataattctccttcatcgtagtgaatctattttaacaaaaattacctgctttaacagatagttaccactactaacgtgaaaataatactctttattttataagaaatgaagaatttattccaatgatttaatgaaatttaatgaacaatagtaatgaatatcattttcaaaaaggatatgataatgtggatgtgtctatttaattgagagaaggagaattttgctgtgtttttatatcaacatcatcgtttatatcgacgcaaaattttgattacaagtttcctgttaccagttattttgatggcttgctattttgcataccgtcaaatgactccctttggcaaaagcagcttattaaccgttgatctcggtcaacaatatgtcgattttttcagttaccttcgaaataccattctccaccatcccagtagtttcttttattcgtttagcaaagggctgggtggcgaaatgtttggaactaatgcatattacttgctaagtccattaaacttaattttgttatttttccctgctcaacaccttgcaactgggataaccatcgttacactcgttcgatacggtctagcgggattgagttttgcctggttaatgcaaaaaacggagctacaacaggggtggcgaattttagcattcagtacagtctactcaatgaatggctggatgattgccaaccaattaaatatgatttggcaagatgctttaatacttttgccgttaattatttggggactccttaaacttatttatcaaaatcgtgttggcacttatatcgcttggctagccgtaatactgattgataattattatatgggctggatgattgccatctttacttttctatttttcctctggcaaacaccagctttggcgtcatggcgacaacggggagtaatctttctccgctatctcggtagttcgctgcttgcggcggggatttcagcagtcattttattgccaactttctatgccttgatgcaaagtaaagggacgtatactgaaaccaagattcacagccgttttgagtactttgctcctaaaatgcttgggaaacttgttcccggatcatttaattttaatcaaatgccaagcggtcagcccaacatttatattggaatgctattaatgctcggtgcttgtctctactttttcaacaatcgctttgaccttcgtcgtcgtttgattggggcagccatttctattttctttattttctcattctgttacgaaccattagatcttttatggcatgccggacagtttccagtttggtacccttatcgtttttcctaccttttctctttctggtgcatctatcttgcagctaaagtgcttcaacctgatttcaaaataaaaaagcgcagtgcacttatcctgacgttgcttattatcgcaatttactggtatgttggtatgcttaacttatcgtatattaatagcaatcaacggaatatcggcttatgctttgcgctgatcgctgttagttgcctttgtattccccgaacaaattcaccgcgcttatacgacgcgcttcttgttctccttgctgtctgtgatatttctatgagtgggtacacggcgcttaataagatctcttacgtttcacagcctgaatttggcaactacactattgctcttgataaaagtgtagaaaaactaaagaaacatgatccaggcttctaccgcgttgccaaaacttttatgcgaacaaaagatgaccccttccaagcagactttaattctggtgaccattttggttcgaccttagaaccgccaattccagccttcatgggtgcaattgggcagccagatggggatggctttgttacgtatactaatggaactcaagtgagtgatgcgcttcttggttacaaatacactatgaacgctcggaacacttcagctggacaggcattacccctatcaggtttccgtcccgattggtatagttacccattagtaggatcaacttcagcagtcaatctccgtgagaatccacatgcccttccgatcgcatttggagctaatgccgccatcctccaccttcaacggacaacaatggatccgttaaattatcagtcacagattttccaaacgcttgccggtcgtccaacacttcattcattatttgccgttcaaaactttaattccgttaaattcaataatgttcaaagtgctaagcaaattactggcacgatctttagaaagcaaaacctgcttaaaccagcatcagttcaactagaatttattccgccaaccaacgattcttactacttaacactcggaccaaacgttgaggataatgccacaattacgatgaataacaaaaaattcacccaatatgacacctttcgtaatacggtagtaatcaacgttgctcatgatcaaaaagggcaaaaaatccttgtcaatttgcaactaaagaaagctacactttggatgcaaaacgttagtatctatcaactaaagcaacgaccatttatggccagcttaaagactctccaagaatctcccttaaagattagttcataccgtagtaatcgaatcgttggtacagtcaatctccagcggaatcagcgagtattgatgactactatccctgctgccaagggttggcacgttaaggtagatggtaagcctactactccccagaccgtacttaatacgtttatggctatcccaatgagtcccggaaagcatcgggttgaattttattaccgaccaccattcctcattcttggacttataattacagttctaagtctcggcttaactggatggtgggttaagaaagaacatcaaataaagacaatttttgattagaaataaaggtttgactagcaataaagctctttagcatactatcattggacagtacatgctaaagagctttttcactatataaaaattaatgctgcgatgctccagtagaggcatcagccttattatcggaatgatcatcagcgtcattaacaaatccagctacgtcaggtgtatcgccatcttcatgttgaaaatgaaataccagtccgtctacttgcggatcatagtcaacagtagtgataagatccttaaaaaaccattcatctagcgaatcaatgtggtaattaatgccatccttttttacctctaaaatcgggtcaactggcttatcttcacgagtaaatccttgcgaaaagccatgatggacttcagtttgaccataagttttgccgtaaaactttactccattcccaggttctaatcccatttcctcacgaaaccattgacttgcagcatcagtaataatcaatttcatttttcttccctcctacgtttgttgatatcgctttcatacaccttactatagcatagtagagcaacaataccaataagaaaagcgagagggagcgagacagaagttacaagtaacttctgtctcgctccctctcgcttaaaagatattgattaatcaaccttaacaatctttaacttaattgtcccattaggaacttcaacttcaactacttcgccgaccttgtgaccaagtaatccctttgccattggagattcattcgaaatcttaccattaaatggatcagattctgattcaccaacaatttggtattcttctggttcttcatctggcaattcttgaatagtaattgtccgtcccatggatacttcatccttgtcgacatcttcattatcgataatttcagcatattgaagcatgttttcaatttgcgcaatccggctttcaaccattgcttgttcatcttttgctgattcatattctgaattttcagataaatcaccataactacgagcaatctttatccgcttaataacttctggtcgacgcttcaagcggtattcttcaagttcgtcttcaagctttttcttcccttcaagggtcattggaaaagttttttcttcagccattataaacactcctcataatttatccagtgcaacattaccatttctacttcagcttgtaaatacctatcgcaattcggtgtgtccacgttttactaaaatatcgcggatttttgtcgataataggtcgattgcaacttggttttcgccaccttctggcacaataatgtcagcatagcgtttagttggttcaacaaattgatggtacattggttttaccgtagccaggtactgagtaataattgaatcaagggaccgtccacgctctaccatatcacgttgaattcgacgaataatccgaatatcatcatctgtatcaacataaactttaatatccattaaatcccgtaaacgttcatcatcaagaattaagattccttctaaaataatgacatcagtcggttctacatgaacggttttgtcggaacgcgtatattgtgtatagtcgtacaccggcatctcaatcgccttattactccgcaaatccgttagctgtttaatcaaaaaatctgtatcaaatgcaagcggatgatcataatttactgctttacgttcatccattgtcatatctgactgatcattatagtaagtatcttggttaataatctggatcgcttgtccatgcaattggtcatagattttattacttaccgttgtctttccactaccggaaccacctgtaacaccaataactactggacgcttattctgttgaatactcatcaatttgtctccctcattaaactttctaatctgaaatagtatatagcactcttttgtgatgcgcaagataattactaatttaaattattaaaggcgaggtaaaaagtgaatattaatgcataacaacatagtaatttccagggaagtattgttggtcagtaattttaactgtttcattctcgtttggagcttgaataatccgaccgtcccctagtgaaatagcgacgtggtatggcgcatcatcagaaccataaaaaacaagggccccatatggcgcgtttaagacgttatcgtgaatatgtggtcctaaagcttgttgttcatacgtcgtccgttgaggaataccgtagcaatattgaaccaacccagaacaatcaaatccacctggcttattaccaccccaaacataaggggttcctaaataagacattgccttgttaacagaatcttgtagattttgactattcttgttggcttgatcctttttctcagtattattagcaggtgtttcatttttatctttggttggaattgtcaacttttgtcctgcaaaaatcaactctttattttgcaagtgattagcggttgcaatatcatccgcactaacattatacttttgagcaatcccatttaaactatcgccagcattgaccgtaacagttgcatcagccttagcagttacagtacccattgccattgcgccagctacccctaacgacgatgcaagaattttcttcgttgttgatttcattatttcgtttatccctctttaatatcaaatgtttttattttatcaaattattaataaaatagcagaaaatttttagcccttcaaccactaattattactttagtgattggccctataatataaatacgtaaaaaataattatttgcactaaaaaaaggccgaaaaaatccagccttttaatttttaacgaatttctgcatcaatcttatcttgcaagtaagcagtaactttatcaaaggccgcgtttacttggtcttcagtcaatgttcctttattatcttgataagttaaggtgtaagctaatgacttcttaccggcaggaaggtgcgaaccagcataaacatcaaataagtgaatatctttaaggtaagcaccacccttttgcttaatagcctcgacaatcgttgcattttcaacctcatcatcaactaagagggcaatatcgcgagtgattgaaggatacttactaataggtgtatattcattttcaatctttggtgcagtcagtaataattcgagatttaattcaaatacgtatgtttcgggaatcttgtattccttagcagtttgtgggtgaacttgaccaataaagccaactaattggtcatcaaccataatatcagcggttcgtcctggatgcatttctggtcgatcactagttggaacataagcaaccttaccagcaatccccatattcttaaggtaacgttcaacgatcccctttaattggaagaaatcaaccggttgatctttcttattccaactattagctaccatttgaccagtaaccgcagctgcaaggtgttcttgttctactggacgttcatcccccattggcaagaagacccggccttcttcatatagtgctacattgtcaacattccgcgccacgttgtaagcaatatcattaagcaagccgctaacaatattcatccgggtagctacatggtccgaactcattgggaagtcaagtttcattggttcagcgagtggcttaatttggaattgcttagccttttcaacagttgtgagagaatagctaattgcttgagttaagcccattccttcgaggtcatgacgacttgcccgaataaaccgttgacgtggagtaagtcctccccggttacgcgtcatcgttggtaaagtagatggcaagttatcataaccgtaaatccgcgcaatttcttcataaagatctgctgcaagactaatatcccaccgccgtgctggggcaattactgttaattgatcatcaccatcaacagtgtaagcaaatgccaagcgatcaaaaatatcagtaacttgttccatggttaatgaagttcccagaacatgattaatctttgcaagggatagtttgattggggtatcaactgctggcgcttcactaccagttacaattcctgctgtaatcgttccccccgcaagctccttaatcatttcggctgcttcattcaatgcggtttcaactgttgctggattgattccgcgttcaaaccgcattgaggattcactatgaagatctaagcgccgtgcttgcttccggaccattactggatcaaaaatggctgcttcaagggcaactgttgtcgtatcatcacttactgcagttccttctccacccatcgttcccgcaagcgcaactggctggttatcgacagttacaacaatatcatttgcttttaaggtttgttcatccccgtctaacgtaacaaacttttcaccttcattagcgtggcgaaccccaaagtttttaccagataattggtcataatcatagctgtggaggggttgaccatatttaaggaggatatagttagtcacatccacgacattatttacaggacgaataccactgttccagaggcgaatttgaagccataatggactttcggcaattttaacacctttaattacccgtaatttataagttggcgcaatcttagtatccgcaatttctgcttgaagaaggtccgctgtcttttcagtcccttcttctttaattgcgacttctttaaaatgcgactttaacccgtaaaaggctgcgatgtcattaacatttccataaatactaagcatatctccacgattaggagttacatctgtatcgatgaccgtgtcgtccatccctaagtacttaaatacgggatcaccgtttttagcatcatctggtaagaagtagataccatcttcgtaatctttaggcgcaatcttgtcgctaaaaccaatttcttgaagagcacaaagcattccgtttgactcaacaccacgaatcttaccacgcttaatcttttggttatcagcaattcgcgcaccgtgaagggcaacgattacctttttaccttcttgaacattaggagcaccacaaacaatttggatcggttcttcttcgccaacgtccacttgacaaacatgaaggtggtctgagtcagggtgattttcacattgcactacttccccaacaacgatcttttttaatccgtcgctcagtgagtaaacgtcattaatgtcaacagaggtacgagcaatcttttcagctaaatcttgaggggcaacatctaaatcaaggtattcttgaagccattgatatgatactttcatttcacattatcctttctggtcaaattggttaaggaagcggacatcattttggtagaagttacgaatatcgtcaacgccgtacttcagcatggcaaaacgatctggtccaagtccaaaggcaaaaccaccgtattcttctggatcaacgcctgacatcttaagcacatttgggtgaaccataccggcaccaagaacttcaatccaaccagtttgcttacaaattgcacaacccttgccaaggcagttgaaacaagtaatatctgcttcaactgatggttcagtaaatgggaagtaacttggccgcaagcggacctttaacttgtcaccaaaaaggttttgagcaactgcttcaagggttcccttcaaatcagccatggtaatatttttaccaacaaccatcccttcaatttggtggaattggtgactgtgagttgcatcatcagtatcacgccggtaaaccttacctggtgaaatcatctttagtgggccttgactaaaatcgtgtttttcgagcatccgtgcttgcattggtgacgtttgtgtccgcatcaaaacagatggcgtaacataaaaggtatcttgcatgtcacgagcggggtgatcttttggcaagttaagcttttcaaagttataaacttcttgttcaacttcatccccaactgctacttcataccccattgatacaaacaagtccacaacttggtcaatgatttgttgaataacatgaggttgtccttgtgctactggtgttccaggaagagtaacatcaattgtttgggctgctaacttagcgttcatagcggcctgttctagctcagcacgcttttcttcaatcgctgctgacaattcatcccgcaccttgttagcaaattgccctacttttggtcgttcttcagcgctgaggtcacgcatgcctcgaagaactgacgtaataggccctttctttcccagcatctttacgcggatttcattaattcgttttaaatcctctgattgtttaatatcttgcaatccttcttcacgaagttcggctaatttctctcttagtcccatattttcactccttaattcaaaaaaagcctcatcccaatatagggacgaggcttcgcggtaccaccctagtttgtaggggaaaatcctacacactctagtaatcaataacggtgattggccggaataccattacgtatcagctccgaaagtgaaattcgctttagatcactgattgcaattctcagctcatggttgcaactctctaacaggatcgtttagctactagctctcatcatcgcttttaattcaattacatattctagacaatcatctgtaaggcgtcaagcgttatttttaaatccacttgtcactccatgcgtgaacagcttccatgactggccgcaattcttgaccacgttcagttagcgaatagtctacccgactagaactttcgtaagtgttccgaacaacaatttgttcgtcttcgagttcttttaatcgttcacataagactcgatcgctgcactttgcaatgctactggcaatatccttaaatcgcatgttgccatttttaagtagtacttcaatgattaatccgttccatttctttcccaagatcataaacgtacgtgtaaattttggacaaagtttacagtcttcatcaagtgccttttctgctactaattgttccataatttaactctccttctcctctaccaagttgttcgcatccgacgtttcttaatctttcgacgcatctttgcacgtagcgggccaaagaattcatgctctgcttcgaaatcatcaactagcgatacaattaaactctccggatagcgtggcactgccaacgttgcgccaaacatatgcttaaggataatatccttttcttttttatttaacggggttagcttttcagcattgcgtaatgcaactcggggatgaataaatgcatgggttcctaaattgaacttagtcgtccgccaatcataataaaagagatcatgcaagaggcctgcccgcgcagtactgcgataatcaagatgcatttttttagcaattttgtagctatcatacgaaaccgcaatagaatgttgcaggcgggtagagtgatgatgctgagtatagttcgctagcttttgaacagctggctgggctaaaagatcggcaacgattgaaacatactctttatcggtgcgccattcattttttgatttcatgtaataccccttttctatattattgcaattatcatacacgattttaacgagaaaataaattaatttaatctagattttgattaagctgaaacattaagattcccgcagagatagcgacgttaagcgattcggcttcaccacgcattgggatatagaggttatcagttgtctgtgaaagaaggtcatcgctcatcccctgcccttcattgcccatgattaaggcaaaagtatcaccgggatcaacagttcgaaagtttttggcttggggattcagttgtgttccatacaccggagcattgattgatttaaaatcatcaatccactttcttaagtcaccctcaaacatttgaaggtggaattggcttccttgcattgaacgaacaactttaggaccaaataagtctgctgagcgttgtccaactactactccagtaaacccagcggcatctgctgtccgcaccattgtccccacgtttcctggatcttgaactcggtcgaggaaaagccatgccccatgcaatggccctgctggtaaacgatgagaatctggtaaagcaacaaccgcggcaatcccttgcggcgttaccgtatcagtaatatgcttcatgatctcttcagtaacttcataggttgcattagccattccttcaagctctggatgggcagctaattgttcagctgtcccgactacttctaaaagctcgattcccgctttggatgcctcttgaactaagtgccagccatctaacaggtaagtaccagtctgccgtcgcgcttttttggtttgcagcttcttccaatctttaacgtgctgattatgaattgatgttaattgttccatataatttgcatgctccttcttgttaattaaattataccatgttcctgttgtacaattgttattaactaataataagttttcattaaggagttttaattatgattaattaccatcttaccattactgggcacgttcaaggagttggtttccgctggagcgtctatcagttggcacagcaggctggaattgagggaattgttatgaataagaatgatgggagtgtttattgtgaattgcaggggcctatcgagattgttaaacaattaatctttaaaattaaaactgggcccactccttatgctcgaattaataaggttaaaatcatcgagggaagcctgcaaaactaccatcattcatttcaaatcacgcattagttcgcgattagcggtagaattcaattcctgaatagagtaaaatacgtactattaacgtaattaatatacaaagaaataagggagtttgattcattaatatgaaacgaaaacgaataacgatcgctggaggtctctttaccctcctgttgcttcttagcggatgtgtacggactactaagagcggtcgaccatacgggtttgtctatgattatatggctaaaccaatgcagcacttgatggaatggttagccagccatatgggcaataactacggttgggcaattattgtcattgtggtagttgtgcgaacaatccttttaccagtgatgttctcacaaatgaaaaaatcaaccattatgcaagaaaagatgtccaaggttcaaccattgattaaagaactaacagaaaaacaaaaagcagccaagactcctgaagaacaggctgccgttagtcaacaaatgatggctctttaccgggataacaacattagcttaactggcggtattggctgtctcccattgttaattcagctgccaatttttgccgccttatatgctgctatccgttattcgccagacctttaccatgcgactttctttgggattccacttggtaagccaagtattatcttagcggtcttatcttttattgcctatgctgctcagagttatcttgggcttgtcggtgttcctgaagcccagaagaagcaaatgaaggctgctatttggatgagtcctttcatgaccttcttcatttctatcacttcttctgccggattaggtctttacttcttcattggtggattatttgccatcttacaaaccttgatggtcaatgcttaccgtccgcggattcgtcgccaaattgaggaagagagcaagaagaatccaattaaaatgccagaagcaccagtaattaacacccctagttcttcaactaaaccgactgatgcaattgaccaattacgtaaaggcgatgccaagccaagcgatcaagcaaaccgtaatcgtcaacgtaatgctggcaaacagcaacatcataaaaaataattatcaagaagctgggagaaagcaaaagttttttctcagctttgttttttcggaggaagacacatgattaaaccaattattaaagatcaacaattactcgccaaaaaagcaacccccacaactaaagctgatttgccccttgcaaccgatcttagcgatacgcttaatgctcaccaagctgaatgtgttggaatggctgccaatatgattggtgtaaataagaatgcaattattgcacgaatcgggccctttaatgtcgtaatgtttaatccgcaaattgtcgctaaaagtcacccttatcaaactacagaaggatgtctttcattgagcggaactcgtcctactaaacggtataagcaaattaccgttaaatttcgcaatcagagctggcaagtgcaaacattagaacttgcggattttgctgctgagattattcaacatgaaattgaccattgtaatggaattataatataagcaatgagaatatttgctaaaatatcgataaatgaaataaggaaagtagaatcgccgggttctgcaacaaattaatttatgcttctcaaacaggcgtccaacagggaggatgggagcaagttttgtggaggttttaatatggatttaccaatgtcaattacgaaggaagtacggcattatgttgttcgtaatgttgtcgccactcttgggatgtcaatgtatgttattattgacaccctttttatttcaatcgcggcgggagctttaggcctaactactcttaacctggtgctgcccctgttcaacgtttttaatggaactggactattacttggagtcggtggcgccacaatcttttcgttaaataaagttatgcatcctgagagaataaaatcattatttagtcaactgatgatttttgcttttactttcggtcttatcctagcaatcctattaaacatttttgcgactccagtagttaattttcttggggcagatgatgccactcgtcagatggcaatcatttatttacgaataatttcatggagtggacctctctatatggctaactacattgccattaatttcattcgtaatgatggcaatcccacgttaaccatgaaggccaccttaactgaaacattatctgtcatcctcatcgactggttctttatctttggaatgggtcttaaattggaaggagcagcattggcagtgttattttcgccagcaattagcttgatggttttaagttttcatcggaagtttgccggccgacaattacaatggcactgggttgtccctcacctaagaaacatttggcgctcagcacgtttaggggttgcctcagcattaaacgaattaagtactggtgttagtatctatttctttaaccatgttttattgcaactagctaataactatgccgttgccgcatatggcgttatttccaacattgccatcgttgtgctggcaattgctaatggagtagcgctcggtgttcaaccgcttgctagtcgggaatttggtaaacacgaatacaagaatgtttcgatgacattaaaaaatggaattatcattaccctctttctagcaacaatcagctttattatcctaatcacctttaagcatcccattattgaagtttttaacacttctcattctggtcaactcctcgcctatgctagtgttggcctcccgatttactttacaagtgtattcttcagcgcgttaaatctattgttcatccttttcttaacagcaattggatcagcgcgggcatcattctctttatcgattcttcgtggttatattattctcctccccgcgatctttattctggcaaaagttgccggaattaacggggtctgggcagcagttccttttactgaatttgttattacttgcatcggtggaattatcatttaccagcgacttaaaaaattgaataaagagtaagtggaaaatcttctcgctaaggttcgtatagataaagagactattgaaaaaatcaaaaattttttcaatagtctcttttatctactttgtaattttctttgatgcgtgattgtagaaaatccaagcaacaattccaaagaaaaccggaccaaatgctgtccagaatgcagtttgaaaatcatgctcaataatcggttggatacacgtaaagatgattcctaggcaaacaattatttcaacaaagataactaatacatttgtccaaaaatgattcttaaataccacaaaatcatgtggaatatccttcttttgaaagaatgggaatgcaccaacaaggaagatataaggggcacaggttgaaacattaaccatatctgtcaagatttggtaaaaactagcagctgctgaacccccaaatgcaactaagaaaataatacacgaaacaaaaattgcctgaatccacattgcatatgctggcatcccgtgtttgttcagtgtcacaatctttttaggccataactcaggattagctcccatgataaaggacttaatcggggagtaaactaacaggaacattgctcctaacatccccatcagcccagctaacgcaatcattcgcgtaaagagaacaccaagaaaaatattagtagcatgacttaaccctagcgaaacacctagttggtatcctaattggttaaagacaacgtaagtaacattacctaagttaacgcttgattttgcaataacatgattgtaattaacgctaaagccagtcatcaagatcattaatacgtaactgccaatcgttaagagcgaaccaataactaagcctcttggaaatgtcttcgctggattcttcatactatcagtaaccccaccaagattttccattccaccatatgcaaaaattgcgtaaacaacgaatgagataatcgcaattggcgtcttaaaagcaggattaggcgattcgataaaactgctaataccatgaataggctgggcggtaacccccttgttagcaataatcgtcactaaacttgcaataataaaaatggcattcattccaatcataaacgccccaccaaacgagctgattttcgtaatcccattaattccctgtgaactcagcaaagtcaccagtaaaacgaacagaattgccaagataccaattaactgattagaattaaaaatccaaaagtgccattgttgggtagtatcatggccaaataatagtgccgacaatgttatccaaagtcgagatgcacttgatactagccacagaacccaactcgctaaccaaataaaggttccgataaaggccagccgttccccgatcgaaccagctaaccacgaataaattcctccttgggcatccttaaacgccgagccatattcagccatcatcaaacaacaagggaagaagaaacaaactccagcaaggatataccaaaacatccccgcatatgccatttgatcataagctattgaaacattaccaaacccatatattgtcgaaataatcattaacaccaatgttggcgttgtgattaattttttctgctctttcgcagccactcctattcaactcctcaataaaaatcctcatattttagtatccgttttcattataccgcccttggttgaaaacatcgcttattttgtcggccatttggaaaacaattgaataaaaatgttttgtaataaaaaagtgaggacaggagcaaaaatttctcatcttgcttctattctcacatcttaaatatttatttttttgtctctggatcttcaataatcggtaaaatgattctaaacaatgatccagcaccgactgaactttctagggtaatcgaaccgtgataaccttcaattagtcgcttggcaattgaaaggcctagtccattaccgcccttcttacgactacgcgccttatctactcgatagaaacgatcaaagacccgttttacattttctggtgagatcccttcaccaaagtcctgaataccaatctcaacagtattcattccccgtgaaagaataatatggatctctttatggtcatcggtggaatatttgacagcattatcacataaaattacaagtacctgttcaagatggtcgcgataaatatcaaccatgattggctctttcagatcgtcgtccaaacggaaagtaaagtccggatacaacatcttaaagttattgtagacctgatgaaccacatcattaacaatcgtatgctgattgcggaagttaatctccacttgctctgctcggctcaaatcaagcatttcttgaaccaggtttttcattcggcgagtctcaattaatgttgctttaattgagtcatccagcactttcggatcatccttgccccaacgttgcagcatctccaagtgtccttgaataatcgcaacgggtgtccgcagttcatggctaacatcactgacaaattgtgactgctggtcgatataccgctgcatccgatcaagcatctcattaaacatcgttatcagttctgctagttcatcattacgattggtagttggtactcggacatctttagtcggatctgcactaatctccttaaccgtgtcatgaattccatccaatggtcgaaggaggaaaagtgaaagaaagtatcccaagaggccgctcgcaatcacaaccaggcagagcgccaagatgcacaccaatgctaactgatgataactttgcatataagcatcaaggttattttcaacttgtaaatatccaatcaactgccgattattctgaccataaattggcatctgcccgaccaacacatcatgatcaggcccagcagcaatatgaatattgcgattagtcgtaaactgtggctttttaatataacgacctgtactcaaaatattctttccatcaggattataaatgttaataaccaagtgtccatcacttaattctttaattaccggtcgtttatattcctctccagaaataatattcgaccggtttctgtctggatcaataaggtgactaacattcttttttgttaagggcttatcaacagtacttaattgtgtactaatattggtcatcccttgattcaacaattgtctttcctgatgaaataaattttgcgtaaatgcactaaacaatgccatggcaacgatacaaaagatgattaatgaccctaatgccgtcccagctgcccacttaatttttagcgaaacaaaccgtctttcatctttttgcttcataattgatcattcctaggagcgaatcacatatccagtaccacgaaccgtttggatgtagctcttttcaccaggtcggtcgatcttattccgtaagtaccgaatataaacatcaacaacattggtttcaactttggagtcataaccccacaccttactcaaaaggtcttttcgtgacataacaacattgatattttccatcaaaatcaagagtaattcgtattcccgctttgtaaggttaattacttcatcaccacgacgaacgacccgattctctttttcaatggtaagatccttgtaattgaccgttgtttggtgttctttattattaccatcttcaatactgattcgccgtaataacgcccgcacccgtgcaaggagttcttcaatagcaaatggcttaacaatataatcatctgccccatgatctaaaccagagacacggtcaataacagaatcacgagcggtcatgataataattggtgtatcttttatttcacgaacccgtcgtgcaacttcaatcccatttaactctgggagcatcaagtctagcaaaatcacgtcaaagtcttgatttaaagctgcttctagtccggcacgaccatcaagttcaacatctgtatcgtagccttcatgctttaattcaagttctacaaaatttgctaaattttcctcatcctcaataattaaaattcgactcattaataactcacctactataataatctttttttacttgttatacgtattaataaaacacaataattttatcacaattttttaataaaccccagtattctctgtactaaaaatctcgatttatcaaggaattagattatatcattttttacttataaattcttagaaaattttaaaataaaaaaactatcctaggtccggcgcctaaaggatagcttttatattaattagttgttagtgttaacaacttgcttgccgtcgtagtaaccacaacttgggcataccatgtgggacttgcgaagttcaccacagtttgggcaaggagtaaggccaggtacatttaacttgatgtgaccccgacgcatacgcttcttagtctttgaagtcttccgtgctggaacagccatgtttgacacctcctaagaaattagaattatccacaaatggtttttaaccgtccgctattttttgttatcctgatcaggaaaaaggttttgcaacttagcgagacgtggatcaactttgtcatctttctgctgctgggccttgtagtcatcttcagagataacactccaaccttttccatttggcattggtttgccagacttttcttcggcagaaagaacccgtagtggtacctgttcaacgatattttccgctaatgcagtatcaaaatcaattgaatcaccctttttaatcaggaaaacaacctcatcttcatcctcatagcgggcaaagtgtgaacgatcatcgatatacgtctctgagaacgtaaaatcgagcggtaattgaacgggtgttaacgagcgactagatggaacggttaacgtcgttgtaacatgagcgctaatcgttgcatcaccatcgtcataagtaacgtaaccatcaactttaactggttgaacagctaaaataatatctggaaacagcttcgttaatgatgcgttcagatcaaaagtactttgaatatgaagtggttcatcttggtaacgatgtaattcagctaacgaccatttcaacgtactaacctcctaatgcaacatgtgcaattatactagtccccttatacgttgtcaatgttttttccttgacaaccttttagggaaccaaatctacttagaatattttaccaaactttatcaaagacgttaattaataattatcggtgggtgcttcaaatcttgttcaaccggcgtaaataactgatatagtttccctgcacgataatcaagattaagcaattgatcccgcatttcttggtcaacttttgtaattagtggtagagcaagctccttttttacctcatgaaggtattcacgtccttgcttattaaaggccaaaacatgaagataagggtgtttactatgcttctctacctcttcttgggtaatctgcaagatagtgtataaacaaacccgcaataagtgggcataggtataccgtttagtcttggtaaatttcataaatgaattaaaatcaaggcttcgctgggccgcctccttcatccgatattcgagtccttctgccattaagtaagttgactgaagggttgaaacaggcgcttgaataagctgattccgcaataaaggataaagttctgtccataagggaatactctttattgtcgccaatatatctcccatcacctgggggacagcttgccgataatcgcccttttcactgattgcctgacggattgcactcgcactagcaatcttgcctttaatttgctggtcgtgatagttacttccctgccgcttgataggcagcaattcaaaatgataaccctggttaattttagctttggtataagcaaaagctaaaatatcattgggatcaattaaggtgacaccagtttgttccttcaattgttggttaaattgggtggcgtaagttgcattatacttattaaaactttcctggttaaaagcttcttcagccttcaccaaccgagcaaaatcccattctggatgctcactcccaaagacaattgaatcaacgccaagagcatttaagagactcagcgctcctccggcaaaccggtgtgctggttgaacagcgtaaaaaagcggtaattcaatcaccaggtcaaccccattcatcactgctgcccttgccccgtgaccatttatcaacaattgtcggttcgccacgctgggtaaaattaccactcattaccgctaccgttacatctgcctcggaaattttttttgcctgctgaaggtggtagcgatgcccattgtgaaatggattatattcaacaaccatccctactgctttcatgtgaactctccttatttatgacacttaaagaaccatcgtgttgggttttcttctttgatagaagtcgaaaaatttgatcccacttcaacagaattaaagccagcttgagatagcatctgctttaataaaggcaattcataagcacgttcataatgggtttctccaacacgatcatagcgtccatcattatcttgagtaaaaaaagctaattcatgaattacaccatgatcaacatcatcgtctttaaaagactgccacatgaatgctcgctggtggtcttcatcttcgtagttgaacatataccccggataaacgacatcagtttgataaggagaaatgacatcaaataagaagacaccattatctttcaagtgatcagcaatttcattgaaggtcttttgaacggccacagcatcgtctaaataacaaaaagagtccgcataacaagtaatcgcatcatactgcggtaaagcactgaggtcccgcatatcagcttgcaagagattcatattaactcctgcttccgtcgcatgtcgatcggcaatactaagcatctcagtagaaaagtcagcaaccgttacgtcaaatccacgagcagccagcatcactcccaaccgtccactaccgccagctaaatctaaaatattcttagtatcagcaggaaggtttttgattgtgaattcttcccacttctggtacatttcaggatcaaaaagctggtcatataactgggcaaaactttgataaatcattaatcattaatccagtcgctaatattgacaagaggtgcgtcggcccataatttttcaaggttatagaattgacgagtttcttcacggaaaacatggacaaccacgtcaccaaggtcaaccaatacccattgagcatggtttttaccttcaacactaccaatcttgacattttcttcatgtgctttttcaacaatggcattggtgatcgcctgtacttgacggtctgaaccccctgtcataataacgaaataatcagccattggactaatctcatcaactttaagagcgatgatatcttctgcgcgccgaccatcggcagctttgacaaccatttctaataattgtttactatccattaatctatctctccttcatattgtggaacccatgcattataggtatctattgtctttggatataccggcttcccatttccaatcaaataagtcagcgtatgttttgtttggtaagcaacccctgcttgaaggtttgcggctgtaattactcgtgccttttttacgcctgcaaagtctcgacccggctcaatataatcagccatgtaaataacctgctcaagctttgtcattactggcgccccagtagtatggtggcgaaccgcatttaggatatcttcatcccaaatccctaattcatccttaattagctctgcaccaactactccatgccaaattgcattaccataatctaagagcagcggattaagcccttttttcttaatctcagcaataaaatcttcgtcaggacgctgtttggcataatcatgacacaggcctgcaatactagctttttcaacatcaaccccgtattgctcagctaacttaatcgctgtctcttccacacgtaacacatgctgaaatcgtttgtcctttaacgcctttttgagacggtcgataagttcagaccgtgtcattgggatataatttttattataaactaattcttcattcacgatataattgatgctcctcaataaacttgcttacggcatctgggaccatatacttgattgattgaccatgttgcacccgttgtcgaatatcggttgaactaaaatcaaccgttgggacatctacccaaattactggatatcgtgtctcattcttcgctctttgacgatgaacgccgacaaaatgaaaatggggcaagcgaattaaatcattgatccggtaccacttgtcaagataatcgaccatatcaccgccgataataaagtaataatcgacatcagggtgcttatctaacaaatacttaatagtatcgtaagtatagctaactcctcctcgctctaattcggcatgctcaatccctaaaaaggggttatcagcaactgccaattcgagcatctgcaaccgcaattgaggatcaagtgaatctttatgatcaatatggggaggtttagcatctggtaaaaaatcaacccgatcaaaacagagggcatgaccaacctgatccgccataaataggtgagcattgtgaataggattaaatgttcccccatagaggccgattcgtttacggtgtccactaaccttagtctccggttgcacctgggtttgcaccttgtctactacactacagctttgcaaaaccgtcactcctacttttacttagatttcagctactcgtgatgacaattcacgggcatccttatttgctgaaactttaaataaaactaatacccgaccaataacttgaactacctgaatagaagttttttcttcaattaattcgcgaacttcatcagttgtaacatctgagttttgcaaaatgctaaccttaattaattctcgacggtcgagtgcaccatctagttgagcaagccaattgtcagtcagaccatctttacctacagaaaatagtggttgaaggtggtttgcttgtgctcgtaaaaatcgtttttgttttcctcttaattgcataagtctttcctttcaaatattaattaaatcattgcgcgccgtaccagagccccgacacctttcggaacccatgcagcaacagtcgtttttgcaggaacagtaatccatcctagaccctcaaagacaatatcgctcttttcggtaatgtggaattcataacgttctaatggtgggaactcattcttttcatcgctagtcggtggggtaagcaaatctcctaagtgtttagcatagaaattatcagcattgtttagctttgtacggtgaattggtaaattattatcaaagtaagcaaccattcccgcacgttcaccatgaagataatcaaatcgcgcaacgccacctaagaataatgtttgaccatcatttaattggtaagtctttggtttaatctctttttggggtgccacaatcttcaagtcttttggcgataagacatgggccatttgttcttgatggataattccaggcgtatcaactaaaacatgcccatcatcaagcggaatttcaatcttatcaagagtagttcctgggaagcgtgaagtagtgatcaattcttttactcccgttcgttgcttgataatttggtttattaacgttgattttccaacattggtaacaccaacaacataaacgtctcgattgtgtcgatatttttcaatcacatcaagcaagtggtcaatctgatggttctttttagctgaaacaagaaccgtatcaattggacgcaatccggcaatatttgcctgttgacgaatccagtcagttaactttggccgccgtagagaacgtggcaacaagtcttccttatttccaactaataatactggattatcgccaacaaaacggtgtaagcccggaattaggcttccattaaagtcaaaaacatcaacaacatacacaattaaagcattggcatcccgaatctgatttaataggcgcagaaaatcatcatccgttaatgacactggagcaatttcattgtagtgccgcaaacggaaacaacgctgacagtataattctcctgtctcctttcccttctccagggctgacttaggcgtgtaacccaagccattaggatcttccgtttggataatgctcccacaacctatacaacgtaattcttcagtttgttgttcttgttcagtcattcaaatcctcctgccattttaaatctggatattttttgtttaagctcttccaaacacgacgttcaaagaagcggttaatacgggtatcccacttatctgtatttaatagcggacgtactaaaatgctgcgaatgcccgcttggttagccgcagcaacatcagtcaataactggtcaccaaccataaccacttcatcttttgctaaattaagtttttttcgtgcacgatcaatcccaaaacttaagggctttaatgatcgcgaaacaaatggaaggtcaaggctattaacagctttcccaactcgttctttactattattagaaataacaattagtggaatatgggcttcctgtaaagcatccatccattcctttaattctggagttccatctggattgttccaagcaatcaaggtattatctaggtcactaaaaacagctcgcactctctgctcttttaattgggcaggagaaacagaatatattgtattaaccatccatgttggtttaaatatctctaacaaagtcgcacctcatcaaatttaatattccaatcggttaacccgattaaatgttctagtatttaattatatcgtgtgctttactcggaaagcaactaattaaaaaaagccgcttatcatgcatacgcatcataagcgaccgaagattatttaggcttagttaagagctttcttagcttcgtcaacgagtgccttgaatgcatctgcatcgttaacagctaaatcagctaacatcttacggttaatgtcaatgttagcaacttttaagccgtgcattaacttgctgtaactaatgtcgttcatacgtgcagcagcgttaatccgagcaatccaaagttcacggaacttacgcttgttgaccttacgatcacggaaagcgtaagcgtaactcttcattacttggtctttagcagtcttgaaaagacggtgctttgaaccacggtaaccctttgctaacttcataatgcgcttgcgacgtgcacgcgtaacagttccacctttaactcgcatgttgaaatcctcctacgtatattaaatagttatttttgtgaagtttacttaaatggtaataacttcttgtaacgctttacgttggtcttgtccatcatgctcaaaccacgtaattgacgacgttgcttcttagtcttaccgtggaaacggtgactagtgaatgagtttccactcttgaatccaccattagctgtacgcttgaaacgcttggcagcagcacggttactcttcatctttggcataactaattcctaccttcttaaattaattctttgctttatcagcagccggagcaagagttaagaaaatactccgcccttccatcttcggacgttgaacaacagtagcgatgtctgaagtttcttcagccatacgttcaatcatgtcacgaccgatatccttatgggtaatagcacgaccacggaaacgtaatgaaatccgcaccttatcgcccttttcaatgaacttacgaacgcgctttaacttaacattaaagtcattagtatcaattgatggactaaggcgaatttccttaaccgttatcgtcttttgcttcttacgagcttcacgctctttcttttgcatctcgaaacggtacttcccgtaatccataatgcgggcaacagctgggcgtgcctttggtgcaactaatactaggtctaagttagcttcttcagctaactgtagcgcttcacgtttagacttaatgcccaattgttcaccattttgaccgattaaccgcacttcccgtgcacgaataccgttattgacaatcatatcttgtgctatggcaacgcacctccaatttttttagcgaaagatcaagcaaaaaagcgaggcacaaaagtaccccgcttcataacaacgaccttatcctagtggtcgattatcattcatctcgtcagcccggcgatcaataccacctaggcgagaagcgggtgcttctgctttttctttcaacatttattagcttactaaattcaaagtttaatgtcaagaactttatcccttatcacgcaaattctttccttccatttcaatctcacgtgataagtacttgattctttccataatgcgagccgctttgaggggctcattatcgccttgcgcattgatagcaaggtggttattttgcaactcatccattgaaaaattagaactaaagaaggtcggtaattcttcttgcatccgatattctaagatcactcctaaaacatcatctcttatccatgttgtcattgcaccggcaccaatatcatcaagcattaaaattggcgcccgtttaatagcatccaatttttcgccagtattattttgcttaattgaattccgcatttcaacagcaaaactagggaaatgaaccatcgttgttgcaatccccttgctcttagcgagttcattagcgattgctccaaggaggtatgtttttccgactccgaatttcccatataggtaaagccctggttgaaaattatctttttggtaattatccgtaaagtccatagctgcttgaattgcctttgtgcgtgtatcagtttgggtatcttcatttaaataataatcatcatatgacgcatttttaatgaacttaggcatattaatcgagttaactagccgttgaatataacgttgtcgttggcgttctaataactgtttagttggaacgtaggttacgtcaatctgcccggcactgataaccaattgtggagaatatcctggggcaacagttggcacgcctttttcaattaattgcttttcatgaaaaaactcataaagctttgattggccccgtttaattgcttctttactaagacgatcacgattttcgtttaagaatgcttgaacatctttatccgcataaacttgcttcatcgtttgttggatattatctgcaatattttgaccgcgcattaactcttgtaaagttttgtttagtgactgcatgctgccacctcctttagctactacttcttcttacgattagcgatccgttcacgcagtttggcaatttcttgtgaggaagcttttttcattagctcactcgtatcttttttactccattctggcatcggttccttaatcgttttgcgccacttatttttctttggcgtctttgttttcttttcttgtgcctgcttgttgaaagtctttaattggacgatggcttgctctccattaattacgccatgttggagccagttattggcaattgcatcgacaaaattagctgtcaaagtagaatttccccggtcaataatcacataccaggttaagatattaatggcatcttgggtaagtttttcttgcgctactaagcctgtcagaatatgacgttcacctgaagttacatagccacccgtctgccctttaaggacctggagaaattcaactggagaataatccttagctgttgccaataattcttgatctttactggtcagttcactatttttatttgtcaccggcgcttctttttccgctacctttgtcgttgaagaatagactatattataagcagacgcgacaatttgcttaaattttttcggattgaaatgattagtttgtagatcaatcgaccgcaaaatcaatgtcttcatcgttggcgcatcaatcccgtataattgatgttctaataatattaggtctcgattattttcaaggtccgcactgacaattggctgattagccagtaagtgaatgagggttgaccaatcaaagtcatcgctcatccccacggttaactggggttgcttttctaccggtgattgttttcgcgccgttaaaatcgcttgtggtgtttcagtaattgactgtgagttaatgtgaaattcttcaaaaaagttatgactcacattagttaatgaagtattagaagaagcaagcttgtattgccgactttgcttagtcaaacgttcaaacgcatcttctcctacttcctctaacagtaaaatactcagcaaattatcagctaaaaatttttctggagtaagggtcggctgcaattcataaacatatacgtccccgatctcatcgtgctgaaaataagtttgcactaagccaactgcctctaaacgatgaagagcctccagcacttgttggcccccagcatttacctgggctaacaggtcgctttgcaaggtccggttggcaatcgtaggattaggcagcaggcgcgcttttaacgcataaaaaaaactaaacgcaactggtcctaagattggctgataaaatgttgcaaaagtctggtcattaaaactaataaatgcagtgctggccgtaacaacataaccggcttgcgggtcaaaagctgctgcagtcattttacagccctcctaagttattttttatgttctgccttcatcatggtttcaagttcgctcataaaggcatcaacgtccttaaattggcggtaaacacttgcaaaccgaatataggcaatctcatcgacgccttttaattcgttcatcacaaatttaccaataatttgactggagacttcgctttcaccaatactccggatttgtttttccactttatctgcaatcttggtcaaccgctccatactaaccggtcgtttttccgccgagcgcacaatcccattgaggatcttttggcgactgaattcttggcgcgtgccatcttttttaattactagtagcggcgtttcctcgtaccgttcaaaggttgtaaaacgaaagccacaatgaatgcactcacgacgacgacgaataaagcttccgtcttcgcttggccgactatcgacaacccgtgatccatttttgtgacaatgtggacagcgcaatgtgtccccctcctttatagtataagtactttattttaccacattttactttgcttttagctgatttattaaggatgcgacttgtttttgcaaggcaacctggtcaccattattatttattttaaaatccgcccgcgcttctttctctgataatggcatttgggcagcaattcgcgcttgcgcttcctttttagaacagtgatcacgagccattaaccgtttaagctgcgtttgcggatcagtataaacaactacaacataatcacaatcttcatcatagtgttgctcaaataataatggtacatctaacaccacgagcggaattccctgtttcttcaaagtatcagcctgcacaaaaattgcatcgtaaatcaatggctgaagaatctcattgagttttttcaacgcttctttatcattaaagacaatttttgctaaggccggccgattgagctcacctgttggcaaaagcactttcgggccgaatactttgacaatcctcgttaacccaaccgagtctggtgtctggacttgccgcgctacttggtcagcatcaatcaccggaatcccagcctggcgcaaaatgttgcttaccgttgtcttccccgttgcgatcccacctgttaatccaactatttttgtcatttcctattccttcaatacttgacagtggggacaaaaggtcgttccgcgttcagcaaccttaattttaaccatttttgtgccacaacgcggacattcatcccccgcatgaccataagcttttaagcgatcttgaaaagcaccagcatcaccaaatgcattcgtaaaactatgcacagtggttcccttgtacttaatcgctgtcgccaattctttgatgatattttcccgtaattcagcaatctggttagctgttaaagtattggctggttgctccggatttatccccgtcatccatagtacctcatcaacgtaaatgttacccagaccggcgacatgacgctgattgagcaagaatggcttaatctttccccgactcttttttaattcagttgtaaagtatggcaaggtaaaggcgtcttctgtcggttcagggccaatcgtcttcaatccaccgacattcatctcatcaccggtttttaccaatgtcatccgaccaaatttacgggtgtcttggtaacataattccgtaccatctgtaaattcaaagacaacatgggtatgtttatcaattggtccgccaatcggttggttgtaatatcttccttccatacgaagatgtgaaatcatcgtcaaatcattagtgaaacgaaaaagaagatattttcctcgccgatcaatattttcaatcgtctggccaatcaacgcctgccgaaaatcttcaacgtcattggtaatcgttttaccataataaacatcgatcgcgttaattttacgcttagcggcaatcttcagcaaaccgcggcgaacagtttcaacttctggtaattcaggcatttaattcctccgatctattttttaaggtcataccaggtatccccatacttactatctactttaagcggcacatctaacttaacggccgaatccattacttttggcactaattccgatagaaccgggatttcttcctttggagcctcaaagactaattcatcatgaatctgcaagatcatttttgcctttagatggcgtttctcaagctcatcttgcatccggatcatcgcaatcttaatgatatcagcagcgcttccctgaattggagtattcattgcagttcgctctgcaaatgatcgcttgttgaaacttttggcatgaatgtctggtaagtaacgacggcgatgagtaatcgtctcaacataaccattctctttagcaaacgcaatcgtatcattgatgtatttctttacaccggggaattcatggaagtaattttgaataaattcatgagcttccgcacggctaacatgaatccgttgcgccagtccataatcactaatcccataaacaattccgaaattaaccgcttttgcccggcgccgcatattacggtcaatctcggcatctggggctaaatggaaaatccgacgagctgtactggcgtgaatatcttcaccattcttaaagtcttcctgaaggtttttatcaccagtgatatgggcaagaacccgtaattcaacttgcgaataatctgaagagaagatttgccagccttcatgactaggaacaaatgccttcctaatcaagcgtccttccggcaaccgtactggaatattttgcaggttaggatcaacagaggacaagcgaccagtttgcgttaatgtttgtaagtagcgcgtatggatcttctggtcatttgaatgaataactttcagcaaaccagtgatataggtagattgaagcttagcaatttgacgatattccaaaatttgctcaacaattggtgacttatcagctaacttttccagcacatcaactgcagtggaataaccggtcttggtctttttgatcactggcaatttcaatttttcaaacagaatatggcctagttgcttagtggagttaatgttaaattcttcgccagcttcttgatagatctgactttcaatttctgatagccgttcagttagcttactacccatatctttcaaagtttgtgcatctacgtggacacccgcaatttccatttttgcaagaacccgggttaggggtaattcaatatcagtatatagtggcgtttgcttattctcgtctaatttggcaaaaagatccttgcgcagctgttcaattgcccgcgctttcgtagccaggtgactaaagaaggtctcgtcatcatcaggcacagcacgcttagctcctttaccataaacttcctcatctgttcggacatcatcgtaaccgtgttcctgagctacttgtcccaggtcgttactattgtcattagtatttagaaggtaagatgccaaaagcagatcaaaattaatattttcaagtggaataccgagacgatgcagaccaacgatttgtgccttggcattgaagacattctttttaacactatcactctggagcaaatctttaaggggctcctctttaagcaggtccacatctcgacttgtaaaccagtgtccttcattaccgatcacaaaaccagcgaatggtgacgtatggtaattttcttctggcatttcaaggtaaaaactgacttcacccgttaattgtcctagttcatctaagttatccttagttaaaaccgtgtagtcaattggagcaatctcagcttcgtcttcctctccagtcccatcgacatccatctttttcaagaaagatttaaagcccatctctttgtaaaacttaatcaagtcatccgtttgtgggccttgatattgcagatcatctaagccgatcttaatcggggcatcctgaagaattgtcgctaatgtcttacattggcgagcaacctcttcatcctcaatcaaatgttctttcatcttactctttttgagatcatcaatatggtcataaagctcttcaactgaaccaaactgttttacaagcttgatcgccgtcttttccccaattttagttacaccaggataattatcggaagaatcacccatcagtgccttcatatcaattatttggcgtggtgtaatccctaatttttcttcgacatgtgccggagtgtagtgttccgtatcagtaactcccttgtgggtaacggcaacggtcgtattctcacttgctagctgggtaaggtcccgatctccagttacgatcaacgtcttgtaaccagcatcatccgcctgcttagccaaagtaccgataatatcgtcagcttcatagttagctaattcataactatgtaacccagagtctttgatcaattcgcgaacataagggatctgctcggtcaattcattaggcgtcttgtttcgaccacccttatagtcatcatacattttcgtccggaaagttaccttccctgcatcaaaggctactaaagccgcatccggtttaaaattttgcaacacatggtcaagcattaacttaaagccataaattgcagctgtatgcaagccgtccttatttgtaaacttgtccatttgattatgcatggcaaaaaatgcccggaaaacaatactatttccgtcaattaacaataattgttttgtcatttaattcccgcccttctatcgctaatagtaattgtaccagagaatatagcaatggtttagtttcttgaccaaagatttaagttataattaaaatgaaaaacattagatgtgagatgaaattcatggataaactcattaactatcaaaagcctgcagaagcacgtctctttgccctgctccttacttttagcggtggcttcatcgatgcttttacatatatcaaatgtgggcgcacaatggcagcagcccaaactggcaacattatttttcttagtgccgcgcttgccaatcacaattttctcggcgtcgttgatcggctcggctcattgattgcatttattcttggattagcaatggtcagcatcctgcacgctcatttaagaactgattattggcgagtagtttgtctgttgccgattttattagtaggagcaattatcggttttctcccggatagctttcctgactatctgatggtaccagccgtttcatttggtcttgcaatgcaaagtgccgctttcagtaaaatcgaagggctcggttataacagcgtctttacaagcggcagtgtcaaaaaagctgcggttgcctggagcgaatattattttcatcacgatcgctcgcaacgatcagccgcctttagttatttaatgatcgtgatctgttttacgcttggcgcgatcatttccgctcagttgcttccctttttccgaatgaaaactatctggatcgcaacgttcttgattctcgtaactgatagttcttattatttaacaaaaaagaatgctaaaaattaatcatttaaagtaggaaaaaggctaagaaaaagtttttgctttttcttagccttttcaattaatttcggtcactcattccaaaaatttgaagaagtgagataaagaggtttacaaagtctaagtacaattgaagggcacctagaacagctaaaccatttgttgatacttcgccgccatagttgatgtagatttgcttcatcttttgtgcatcccaagctgttaaaacagtaaagataataacagcgataaaggagaagatgtaagcaatggcaggactttgtaagaacatgttgataaggtaagcaatcattaaagcaatcaaggcagccatcgcgtgagcaccaaacttgcttaagtcgcgcttagtaatggtcccatacaaagccatcgtgacaaaaacagccgcggatgatacgaaagctgaggcaatgcttgctcccgaataaacaccagcaataattgcaaactcgacaccatagattattgccgtcagcatcagcataacaaatgccccaactgggttccgggtagcactaaagcttacccccattgacaaagcaatcggtagcaataagataacccaaaccattccagggtgagcactaaagaaaccgaaaacggcactccggaatacccccatggtcaagtaagcactgaatgcagaaacaagaactgccaacgtcatgtttccatacattcgggtcaagaaactattcaagccagctgcgtcagtgacaacccgacgccctggttcttgagaaaagttattcatcaaaactccctctttctatttaatttgactttatttgactaattataaaaatggtagcagaggccaccatttcgttcaagtaaatctttaattattttaacaattctttgtacttttcttcgtacttttcaacgtcaccggcacccatgaaaacaactactgcattatgatattgcaaaagtttatccatggtatccatgtcgatgccttcactaccgtcaatccgttgctccaaatcagcactagaaacattcccagcattttcacgaattgaaccaaagatcggggtaacaaaagtcttatctgcccggctaagcgattctgcaaagccatcgatgtaagcagccaaccgtgagtatgtgtgtggttggaaaacagcaataacttcacgatctgggtacttttgccgtgccgcatcaattgttgccttaatttcgcttggatggtgagcatagtcgtcaataatggttgtatccgcaatgtcagtctcgctgaaacgacgctttaccccactaaagttagctaattcctgttgaatctcatccatgttcatgtgttccatgtatgcaactgctagtactgctaagctattaagaacactgtgttcaccatataagtggatggtgaatgtgccgagtttttggtcgcggaagtaagcatcatatgttgagccttctggtgttcgttgaatattttctgcccggaaatcatcatctggattagttccatagtagtaaaccggaacatcaacgtttaagtcacgaagactaggatcatctccccaagcaaaaattgcccgttgaacctgcttaccgtacgtttcaaatgaatcacggacatctgccaaatcattgaagtaatcggggtgatcaaagtcaacgttcgtcataattgcatagtctggatggtaggcaaggaagtgatcacggtattcatcggcttcaaaaacaaagaagcgtgcatccgcatttcctttacctaccccatcaccgatcaagtagctggttggttcaaccgctgctaatacgtgtgataacaatgcagtcgtactggtcttaccgtgtgctccagcaatcccaatactagtatgattcttaacctcattttcaacagcctcagggtagcttaaaattttaaggcctaattcatgtgctcgtttaatctctgggtgatcatcatcaaaagcgtttccttggataacaatcatccctggtttcaaattggctggatcaaatggcaaaattttaattcccgccgctaataatggcgcttgtgtaaatgtttccttttcaatatctgaacctagtacttggtgtcctttgtcatgaaggatacgtgctaaagaggccatcccggtccctttaataccaacaaagtaatatgtattttgttccatcaatccaattcctttcaacaattcaatttaaaataaatgcgaggggtagatcagtaactatgatccatccctcactaaataataaagcattataaaattttggcaatagtaatcagctgttttttgttagttttctgggtagaacgtatcggccttagcaaaatcaaccggttcaccgacttcttgccaatcatcagggataatgaataggcctttttcatcgggcgcattcttaatccgtagttcacggaaaccacagagcattccgtcactatcaacacccatcaattgaccaggccaaatgatcttaccgtctggcatcatcgcaccaggtcgagcaactacgactttaataccttctgcaacattaggagatccacatacgatttggacagtcttatcatcagcaatccgcgtttgtgttacttttaagtggtcagacttaggatggtcagtgatcttttcaacataaccgaccacaaatttaggatcttcgtcagctgttaagagcttatcaaagcctgcttcttgtaactttgcatttaatttttcaacttgggctgcatctaaaaatacttgcccgttttcacttgttaattctggtaagatcttgctggcgttcataaagttatagccaagtaatgcaccatctttttcagcggtgatctgagctacatcatcagcaatcttagtaatttggtcatccgcatctggagcggtaataacgactaaaatgtcgcctaattcattgggattgtaacttgaaattaacatcaaatattcctctctctaatataatctaccattttatattattacataaaaagaagactatgaaaatctaatttaaaactaaagaaggctgaatgattcagtccctttattttcacagccttcttattttacttcaaattgtttaaaaaatcttcaacttgttgcttagttttacgatctttattgacaaatcgaccaatttctttaccattatcatatacaatgaagcttggaattccaaatacatttaattcagcagcgaggtcgatgttttcatcgcgatcaacttcatagaaagtataatcactgaagtcttgttcgatctcaggcattgccggcttaatgaaacggcaatctgggcaccaatcagctgtaaagaaaaggacgaccttgccattgccaatagtttcaattaattgatcttcttttaattgtggtaatcttttcataatcctcatccctatatcattttagcaatattataccatgcttcttatctattgtaagtaatctgcttgcaaggactagatatttggattctaataattaaaaatgatagaataaatgagaagttaagaacggattaaatttaaatagtgaaggaagcaatcatatgaatgcaaacaataactccctcaacccctggctgattccagtcacattaggtgcatctggaatcgccggttttatcgctggtaaactttttggtaaccgccaaatatctgctgatcggatcttaaaattagtcaaaaacgattttgcaagtgaaggttctttaaccggcagctggatcaatgataaagcagtaccttttcaacgattcgcggttaaaacccatgcttatgaaggcggcgtttctcgtctagaagatggcgaagaagtagattacgagtttattgctgatgcatatactggtagtctattagaattaaaacggattgagaataactagagtaaaggctggggacaaatttcccggcttttttaattaaaggaggatatcatgaatcttaatgacgcaattcaagaatgttggagcaaaattgatgaaggacaggtagcaacctacattcccgctttagcaaaagttgacccttatcaacttggcgtttacctttttgacgtcacaaatgataaaaaagcagaagcaggcgcatcgcaagttcgatttgccatcgaaagcgtctcgaaagtaatcaccctcctctacgcaattgaacgtttaggcttgtcagcagttgaagaacaagtcggaacacgccaaactggcttccccttcgatacaatccttaacatggaaattaccaaagagacccatcctctcaacgcttttattaacagtggcgccatcctcattagttcattaatcgaagaacaagatgggctttctccctttgaccaaatccttgaatttagtcgtaaaatctgcaatgatcccgctatcaccctcaatgaagaaatttaccaatcggagttgcgaaccggggatatgaatcggtcgttagcctactatctcaaggccaaagaagtcctcactaatgatgtaacccttagccttgatacctattttaagcagtgttcaatgatggtcacttgccaaagtctagctaatctcggtgctgtccttgccaatgacgggatcgctccttggaataatgaacgaatcatttcaagcgaggctgctacatatacaaaatcggtcatgatgacgactggcctctacaatgaatcaggaacctattccgttcgaatcggcgtaccgactaagagcggtgtcggtggcggtttagtttctgcttcccccaatcattacgggatcggaattttcagtccggcactcgaccatgctggtaatagtgttgccgggctagcactccttgaactcatcagcaaaaaattaaagcttgatgtttttaggtactagttgcaaatatccgcctccttatcgggatctgcttaattatattcaacgttcaattcagtttcgttaatttactattctaattagatatttaggcacatcccagggatacttttagtataattaaggtaattgatgtatacgttttcactaacaaggaggtttctcatgatgtatccagtaacaatcggtcattcagaagttaaagtaaatcccctcggtcttggaacaaacgctgttggcggttataatctcttcccaggtttagatgatcaagccggcattgatcttgttaagactgctttagataatggaattaatttattagatactgcctatgtctatggcttgggtcattcagaggaattgatcgggcaagccattcaagattacgatcgtcataaaatcatcattgcaacaaagggcgctcatgatttttcaacgggtaaagaagttattaataatgatccggattttattactaagcaggtcaatgacagtttaaaacggttgcaaactgactacattgacatttactatctgcacttccctgatcatgatacgccgaaagcagaggcagtcggtgctctgcagaaattacgggaagaaggaaagattcgggcaatcggaatttccaatttcagtcttgctcaaattaaagaggcaaatgcggatggttacgttgacattgtagaagacgaattcagccttcttcatcaagatcatttaacggaaggaatgctagattacctccatgagaacaacatcagctttgtcccttacttcccgcttgcttctgggctattgactggaaagtataccactgatgcaacattccctgctgatgatatccgtagccaaattacagaccttaaagagccacgttacagcacaatcttacatgctgttgatctcgtccgtccaattgctgataaccatcatgctacgattgctcaaataatcctcgcatggtacctgcaaaatccactcattactgcggtgattccaggagctaaaaatgcccgtcaagtactctctaatgcaaaagcaatgaaaattgaactttcgactgacgaatatcaaacaattgaacaagcattcaatcaatttaaacaaattaagagtggtaaatcattaaaagatccagactaaggggaaaaaccaccaaatcgtttcaaaaggaatttatcatgaattatttcatcactagccggcaagatttacacacctcggccatcgaacttgcccaagtcaaacggctacgaattttcgatcatctaaatgtccccgcgatcattgtcacgatgctgtataacttcgaccatcaagctgttgaagaaaagcttaaagttaaaggtcgcatccttaacatctaccagtattatcaacagcttccttatcgtgatgatcccacagttgatcaagccattattaagcaggtattgactgtccctggctgccaagttaaggacaattgtgccctacgcaatggcaaagtgcgggtccgcgtgaacttccgcaacggacggttatactatatcgactaccttgatcagtacggctttaccaatcgacgggacttttacgatcaaggatggcggacatatactgactattttgaagataagggacggttaattgcccgccagtattacaatcatgatggacaagtaaagataatctatcattatcgtggtggcgaaggtaatgtccccattcttaccctcatccagctagttgatcaagggcatgaatggcaatttgataataaaatcgaatttcgggcgcactttttagatgagcttgttggagatgatccccaatcaatccttatcagcgatcgttctaatatcgcgctaaaggcgtttacgctaatgaaaaagccggccagacggtatcaggtattccactcggcctttaccgacgatggtcaaagcaacggccccatttcggcaatctaccagccaatcgcaacaatgctcgcaaaaggacagctaagcgggctgatctctgccacgcaacgggaagctcaagacgctgcgaaacggttccaaactaaccagagctatggcatccccgtgacttatttgacgggtgcagagctcacaaaagaaatccccgttagccaacgccagacaggaaaattcattgcggttgcccggctttccaaaatcaaacaacttgatcatattatcaatgcgataattcgtctccaccaagactttccgcaagtaacccttgatatttatggttatagcgatagttggaataaaaaccaaaccgctaatgctctgaagtcattggtaaaggaaaataaagccgagagctatattaatttcgttggttattgtgatgaccttagtgctgcctatgaacatgctcaagcagaaattctaacgagctattacgaaggctttgcaatggcagtcctagaagcacagggtcatggttgcccagttgttagctatgacatcaattatggaccagcagatataattgatgaccagcagagtggtaaactgattccgccgaatgatcaagaggccctgtatcaacaactgcgaaaactattagcagatcccgccctcgcaaaaaagtacgcccaccatgcacaaaaagcggcccaaaaatacaactttgatcatgtcgccgaaaagtggcaaaagttaattaatcgagtaggagataattgattagttcaattatcgacctctcacaccaccgtacgtacggttccgtatacggcggttcgacaacttaatcactttgaattgactggagcgtcttggacatattcataagtccgagttgttccagttttctatttgttagagaatagctcaaggtcttactgtgtgcagttcgccagtagcccttgcgggtactagcgaagacgtatgcatcacgctgggacagccccagcttctgtaagttagttaccttagttttaagcttcttccattgcttccagatatactgtcttattcgggccctcaaccacttgtcaaggcgttgaataaagtcagttagtttcccaattgagtagtactgaagccatccacgcatttttcgctgaatttcttcaaacattcttgtcagagatattccacgattacgtttagttaataacctcaatgctttctttactcgttgttgcgattgttttgctggacgggcgtaggctccattgtgctctacacccaacgaaaagccaagaaactttaaccgtagcgggctaccgactttggttttatctgggttcactttaactttcaatcgcttttcaagaaactgggtaatgcttcgcattactcgttctccggctcgttgacttttaacataaatgttacaatcatccgcatagcgcacaaagtggtgaccacgtctagtcaactctttatccaactcatttagatagatattcgccagtattggtgacaatggccctccttgtggggttcctttttcactcttagcgaaaagcccatggtctaagactccgctagttagaaacttacgaatgagccttagtgtccatgggtcatcaatatattgttgaagatacttaatcatcaagtcatgattaacattatcaaaataggcttttaggtctaagtcgacaactcttcgataaccttgattataaagatctactacttttgcaatagcgtcgtgagccccacggtgagggcggaagccaaaactattatcagagaaaacacgctcaaagataggtgtaagaatttgggccacagcttgttgaaccattcggtccaccactgttggtattccgagttttcttactccaccattaggcttcggaatttctacccgtttgactggtgctggtttatacttgccctcacgcaaactagcaatcaattccgtcttattttctctgagatatggcagaaggtcattgactgtcatatcgtcaatgcctgctgcccctttatttctcttaactcgcaaataagcctgattaaggttattgcggtccaagactaagtcttggatagtgacactcatacctttaccttcaccataatcggtactacgcgcccttgtgtactttcggttttccaaacctatcctcgacaagcggtcagcttgttgttctgttttctgcgattgtcgcacctgattacacctccgatataagttacaagttattgtcgttcagtccttcatctgattactcagactactatgacctcggctgacttctggcttactcaacgctacatcactgcaccgcttgtttctgtggaaattaaacttattcctcttgtcggaaacgtgtaggccagatctccccgggtaaggatattaactttcgtaccatgtcaccggtagctttactgaaagtaacttcgagtagtgttggactttaacttgtcatgcagtcttatccagttagttccagccttatagctacttcttgttcatcggtgcagtactttgccttagacttccttcagattccacctcacagtggacacccttgtcctcagctcatggttccgactactacggcccatagcggactctcaccgcctagctaatacccatgccgggcgcacataaagaaaaaaggagtaatcctcacagccaagatggctaagggttactcctttttattcggaattaatctttccgtttcttatttacttttgttaaaccaagcgctgagagaagaccagcaaaaccgagaccaattaagcttgatgacttttgattaccagtttgtggcaattgttgagcaccttgcttagtagttggttgtgttgatgaagaattagtaggttcgacgatagaagtttcgcctttcttagtattgacttgggtagtcattggttgtggttcttcattcttttgttcaccaggtaattgagtatttgattcaattgccggttgttccgttggttgagcagtcggttgactcgttggctgctctgttggttgaacagtcggttgacttgttggctgacttggtatttctgctttcggcaagtcgtagttcaactcaggaccagactgaccatagtcaagcttaggcaagtcatagtcagtcgatggacctgattgaccgtagtcaagcttaggcaagtcatagtcagttgatggacctgattgaccatagtcaagcttaggcaagtcatagtcagttgatggacctgattgaccgtagtcaagcttaggcaagtcatagtcagtcgatggacctgattgaccgtagtcaagcttaggcaagtcatagtcagttgatggacctgattgaccgtagtcaagcttaggcaagtcatagtcagttgatggacctgattgaccgtagtcaagcttaggcaagtcatagtcagttgatggacctgattgaccgtagtcaagcttaggcaagtcatagtcagtcgatggacctgattggccgtagtcaagcttaggcaagtcatagtcagtcgatggacctgattgaccgtagttaagcttaggcaagtcatagtcagtcgatggacctgattgaccgtagttaagcttaggcaagtcatagtcagttgatggaccactttcacccttgttcttttcgtaaactaatacaagatcctcaggattatttgaagttggcttcaaattgatttcgtcagctgtaccgctaatccagtgccaagtaccaaccatatcatcagaagttgcgtacttatcacctgtgttcaaggtaatgtacttctgaactacttcatccatagtttgagtgtcatggttccattcaatattaccagctttagtagttgcaacttgcgtcctcttaccatttgcatccttaacagtttctggagtggtggtttgaccagttaccatatctacataaatatgaccatcaaactcaaccttttgagaaactgcatccttcaaaggactcttggcatcattatttgcaacaaaggtaatgtttcgagtaaattccttatgtaaatcgctaggatcaatagcacgtttcccatctggatcttttggcacgtcctcaaccggagtgtttggcgtaatagtcttaactgcgtgcttcaagtatacgtattgatcttgaacgccgtgagctaaagtttgcttaccaagcaaatcatccttggcattatcagataatccaactaaaacatagccagccttttcgtagcctgcagggctccataacttttgagtagcatctggagtgtcgccaacaaagatacctttgccttcaccaacgttagaaactaagtgatcggtaagttcatgaccgtcagttggagcataagtagtcttgccttcaacgccgttaacatcgatgtagtgaatgttatattgagctttttctctgtaaacaagataaatatccttgtaagtcttagcagcatcaacatttgcaacttcaggagcaaaattatccgttaattgagttccttctggatcatcatagttagcacgttcaatttcccaaacgccagaaaccttgccttcatccttgttaaatctatccttttggatttgagcaaagttatcagttccaacagctttccaagttggcatgaagttagatggcaattcactgtaagtaccatctgcattcttggcaacttcttgcttagtaacttgatcaacataagcagtacgttcaaagttaacagtttgagtgtcaggatccttcaatacttcatacttgctattgccttcatcagccacgtagtggatgttacggcttacagaagtattctcagttgttgattttacgtcatgaacaaacttgatagtgtagcgtttatgaattaagttatcagcattatctccgccagttgcactcttccaaacaccatctttgttataggttaaatcaattgaactgttgcccttcaagtcggtttgagaaccatcgtcatcgttagtaattgaaacaagcttgtaacctcttgcttcaatatcactaattacttgacttaaacttttagtaccatttgatgcattataaacattgtattgattactaccatcgttctttgtcgttaattcgttagtagcagaatagttgttcccacttaaatcttgaggatcaatctttgaaatatcttcaaatgaaagatctacaggttgattgtgatagtaagtaatagtgattggctccccttcattattaggaagatatgtcttctcatggaagttaccatctttatcataatagttatggtggtagaactttttatagaggtaattgtaagattcaccatttgttggaatcgtattagaaagattctcgcccggtgatttggtttgagttacatcaggatctggagtaacccaatcagtaatagttgggtttatctgtcatcccatcaggaataccagaagctacattatacgatctttgaaccgtttcataactcacatagtgatgaccatctttttctaaattaaagttctttaccactggattatttttagaattggttacatttgaataaccttcctggatcacatctggagaagcaacactatcagaacccgttagaccatattttacataatgaatagtgcgtgaagttattacccaatatggttcattataaaggcgagtttcggttcccaaattgatagtgtaggtacctccatttgttaatggagcattcgataatgaatcaatctctacagtgtaacccgcaaaaggataattcttttctttatttttacgccaatcgtcataggctaatttcatactaggatcagtgatactgtctgcagtatttccacttaaataatcttctgtatctttaggcgttgatactaatggggaaacttcatactttgaattatctgtagttattaaaccttgaatgtatttacctacatcttgaagagtatcaccagttttaccttcataagtaatgcttggaagattttctggctctccgttttcattagtccagtttaaattaatagtagctgaaagtgaagttacaattggtgtatttaaattttgtaattggacgtcattagttttaattacatttttatttctgttagtaaccatttcgacttgacttccacttgtttgtgaactaatagctgcctgtgattgagcatcattttgactaacgacattagtgcttactgattctgctgcggttggcgccggtgtactatcagtattagcgtgtgctactgtacctccgaccataaaagtagttcctagtaacacagacgcaacaccaacactgagttttcttaatccaaatcgttgccgttgcggctccattttgcgtacatattcttgtgcattgttcttcgacattcaatatccccccatatatctgtacgtaataacttgttatttatatttcgaaaacattctagcacatatttatcgaaccataaacacaaaattattatttcattaatggtggaattacttttaaatatactttttcacttgatatcgcgataaagaaatcgatttctcaccccagcaaaaaagcgaaaaaatactagtcagcaagtattcgtctacttactgactagtattttacttaaaattagcaattagcttatagattggttggccttttgccgcaaatttttgctcgtattccgtctcaacattatgttcattttcttcgctgtggtgcaggtctaaccagacgccatcaaagatcatcccatagttattcatactttccaatgagaattcaaagagacccatgttatccgtcttcagttcaattgccccttgatcttggaggatctgctgataggttgctaagaaggtcttgtaggtcaggcgccgcttagcatgccgtttcttcggccatggatcagagaagttaaggtacatcttcgcaacttccccatcttcaaagtattcttgcaagtcttccccatccccacaaatcaattgcaagtttggcaagtcttcctcaagtgcttttttgagggcgattgccgcaacagtccgctgaatctccagaccgataaagttgatttctgggtgatccttcgccatgccaatgataaattgaccttttcccatccccacttctaagtggaggggttgttcttttgcaaaccgtgattgccacttgcccttaaattgagtagcatcatcaatcattagttctggatgggcagcaattaatggatcagcccactttttatgtttcacacgcataaattaaaatcctcatttcattagttttttgactctgacattgaagtagaaacgacttaataaaaccacttccactgccgcaataataagattaattaccatctggccgacgttcaactgccaaccgatactagcaagagcgatcaataatgcttcaagcgccgtcaccttggctaatagctgcttaaagtctgcctgttgctggctagcaggaatcggatagatatgggtaaagacattcgattcatactggtcataaagtggcattagctgagtcgcgatcaagtaaataaagagcacgaccaccagagtacttagccaacctgctggcagtaagaagacaatcaccattcctagtagggtcaaccgactgacaatcccgctcacttcggtactccggacaaatgtgcgagcgtataagtaagaccatggttggtcacccttgcttagccagcgaatcaagccatctgcccacttccgccgtttggtatttccttgaacacttggcacatcggtaaagagattaaagaaacggtagacactgtacatccgatcttgttccgccttaacggcaatccgccaattaacggcaagatcacgataataaacaattaccgccaagtacaagatcactgccacgacaagaccgacatagggatttaccagccacattgcgattgaagcaaggagcggatttacccagtattctagccgggtccgccactgttgatcaccccagcgcaaactcagtgatttacgagctacgtgcatccaatcagccttattgacaatggcgactaaaaagatggtcacaatctcggcactgctgagtttttccgttgtcaatgcgaacggtaaggcgataaaggcccccactaccgtcattatttccgctaagatcaaactataccaggtcgcctggttaaggtaacgatggattccttcaacttgcggcaagagaaagactgggtccggctttttgatcagcgttgcaagccgaccaatttgggcgatgaccgtaaaccagccgatcaagatcagccgggtccaccattcatgcgatcccaaggttggcagccattgggagtagccatacgccaaggctccgaacaggaaaaataaggcgataacaaagtggtcattgaagactagccgccagtaacgcagtaggagcataaagtgttgactgcgacgcttgctaaataacttattcatcacgatcaccctttgcaagatgcaagtaaatctcatctaaggattcgccagcatgatccccagcagctcgcaattcatcaagggttccgtgcgcctggacttttccatctgccaataggacaaagcggtcacaataccgttgcgccgtatcaagaacgtgggtcgacatcaaaaccgcgacgccctcctttttcttttgctcaatcaggtctagcaaatcatgcactgccaaggggtccagcccatagaatggttcatcgataatcaacagcttggccttcgtcataaaggcacagcagatcattaccttttgcttcatccccttagaaaagttagcggggaaccagtcaagcttattatccagccgaaaaagttttaatagttttgttgcccgttgccatgcttcaccgtggtccaactcgtacgccataatcgttaaatcaatatgctcacggagagtcaattcatcataaagaattggcgtttcgggaacataggcgatctgctttttatactcttccgggttggcctggatagtaagaccattaattttgattgagcccgaaaatggtcgcagcaagccgataacgtggtttagcgttgttgactttccggcaccatttagtccaatcaaaccaactaattcacctggttggacatcaaagctgacatccttcaacacgggaatctgggaatatccaccaacaagtttatttatctctaaagccattattcatcccttcttaattattgcttagtcatatctttttattatatcataggttatttcttctactaaatcatgcacgaacacgattttttcggtatacttatgataagtttaatcttcaaaaggagcgattaatatggacgataattgtattttctgcaaaatcattaacggtgagattcctagctacacagtttatgaagatgacgttgtaaaggccttccttgatatttcacaaggaactcctggtcataccctcgtcattccgaagaagcacgttcccgatttatttgcctacgatgctgatctcgctgcccaagtattttcccgtattccaaagattgcccgggcagttaaggcttctaacccggccatcaaggggatgaacgtggttaacaacaacggtgaagtcgcttatcaatctgtcttccactcccacttccacttgattccacggtacactagcgatgatgattttaagatgatttttaaggacaattctggtaactacaacgatgaaaagtacaaagaaatccaacaatcaatcatcgatcaaatgaaagaagactagttatgcaacggctaaaagaaattcaagaggaattcaaacggctcagcagcgaagtttcacagttgaagaacagcatcgatgaactacaagctgccatccctggtgtgcaaaaatttattaacgatgttgaacgtgatgttaagaagtggaaattcaagactgaaccccggctgaaccgcattcagattattctggatgtgctcaagattgatcaaaaggaacagcagaagtaataaaaaagggtctgtaacttaagccaagttactttcataaaagacaaataacgcagtacaacaatggcctccaacgcccggtaaaaccgaacgttggaggcctattgttgcttgcgggggctcgaaaacgaagtcacaagtgaattctgtctcgctcccattttttataccctattttacttgtttgagctagcactactgctgttattgctggagctgcttgtagtggcgcttgagttaaggtaatcatcaaggatattcttaacatcgttttccttgattgaaacgttacccttcttcaagacgtttgaaacaaccttccgcatgaagttttggttgttcatgttttcttgaacgatttggttctttaagtcattgatgtgttgactcttcttacccttagctgggtgttcgatcatgtaaattacttggtagccgtcatcagtcttaactggggtcgtagtgtattcaccagtcttcaacttaaaggcagccttcttgtaagctgagtcaagttggttgtcagtattatcaaaggctggaagcttaccaccgttgttcttggtttgactatcagttgacttggacttagcaagcttcttgaaagtcttgtacttgttgctggagtcatttaattggttaatgatatcttcagcatcagacttactaccaacaaggatcgtcgcagtttgaactttaggttggtacttagtccattgcttattgatctgcttagtagtgatgtgggagtaatgacgagcagcggcagtcaagagtaagtttgaccgaatttgttgcttcaatgacttttcagttaagttttgactttgaagataagcattaaagtctgaaccgtactcgttcttgtaggtattatattgcgcgttaacttgcttatcactgacttctttaccgtattgcttctccaaaaccttatctaagatcatttgttgaagcacttgcttaccagcactggtttgcttcatgctgctgtagtattcgctctcagtgattttaccgccgctagtagtagcgacagccttatttccacaagcagcaagcggcatcatcaatgcgactcctgcaatgatagcaattaactttttggatttcatgtaagaaacacatccttaaacaaaatattttttcgataacttcactcatccaatataccacacttattttttcgtgccagtctcctaaataaatgtttataccatcttcataatttattcacgttttaatgcttgcaggtcaagaatcttaacgtcaaggtccttaatccgatcatcagcagtaaaatagataacctgattcttctcagcaattttttctagcaaggccagcattcgttgtcgccgaacgttatcaaaattaacaaacccatcatcaataattactgggaagttagcttgatcactcatcacggtgacaaagccaagccggagcgcaatatacaattgttcagccgttccctgcgacaattcttccactaaaaagacttcttgatctctccgcacaaccttaatctcatccgccgttaagtcgatctgggaataccgatgatcagttagcaaggcaaaatattgctctgcctgccgaatgattgcggggtaacggtcagctgaagcgcctgcaagagccttatttacccactgaatcgccaattggtacctcaaccattcctgtacctcacgccaaatcttagcagccagattggcccgctcttgttccagattgctgagggttccatctttaactaagctatcaatttcgactttacctttttgaatctcctcgtgggtatgagagattgttaggttgagctgatcaagctggtgccgagccttcgctaaagccgtcattagctcatcgctatttgcgtatgcagcaagggcttggcggtcttctgcggtcaattgttgtccataggcatctgatgccaaggcttgtgattgtgctacagaacgatttgctaagtactgggtaaactggttatcatcgtgcacccctgcttgctgataaatcgccagtttttgctgatgaattttattgtagtcttgattgagctgggctaaattgttagcaatcgttgctttttcccgagtattcacttggatatcctggcgcgcttgttgcccttgttccagcaaatcatccaatttagtcctaacagccgccaacgttagattttgcaaagcaggtggcaattgttggttaaagatagcaagctggtggtcatatctttgctgatcttgtttggcagtttggagctgggcagctaattcggcattttgttgtaaatctccctggattaatagccattgatcaggtggaaaatcctgtaagccatgtttttgaccgaacgccatgatcgcttgagaatctgtcgttactgaagtaggatgatttccttggcgttgataataaagatacataactgtcgcaaaggccgcaattgctccgatagcggtaataaaagtagcattcgctaacagcccgatgataaaaaggacaaagccgccgacaattccgatcattgcggtccgagaaagatcgccatttgactggttcgtatttgcccgagaaagcggttgaacattaagaaggcgggcaagttctgctttttcctgtgaggttaatggcgctggcaagggatgatggtagcgagttttaattgcagttaattcctgttgccactgattagcttgtgtttgttgacggtgctgcaaagcctcttccgcttgtaattcaactacctgctccttaagccgttgaagttccgggatgctttgtggtgaatgtttagttgcttgtggaggctgatgatcgatccttgccaagcgctgttgataaacctgttgttggcgacgaagttccttttccctaacttgtagttcttgagccatcgtaacctgctgatcagttaaataattagcaagcggccgagtttggtggctactttgccattcatggtaaaccggccacaactgttgtaaatgttctaatttttgcaaaagcggctgttgtttttgcaattctgcctgtgcttgccgtaattttgctttgtttgtcttcaaatctgcttgtaggtcctgataacggtgaaatttaccacgcgcttggttaattttatctgtcaaatttgcatattgatgaagatcttgattgagcggccatttccgtccgcgcggtttatagagatggtcagcttgtttctggtactgattgatcaactggtcccactgtgcactaccaactgcccctaattgctgcagatgttgttgccattcatcccgattaagctcgtccacagctgttaggtctcgttgaccaaaactaaaaagagcttgatagagcgaccgatccatcgggccaagcaattgctctagttcttgctcaccaccttgacgtccttgtgaatcagtcacactaaccttaccgccattccgcccgcgttgccgtttaatcacgtaatcatggccgttgatctcaactaataaacttccaccataactagaagtagttttcggaatatactgggcaaaccgattctttccccgcccatccgcaaagccaaataaaatactaacaagaaaggccatcagagttgtctttccggcctcattagggccataaattatttgggggttagctgtaaaatcgaaatcttgatcatgccatttgccaaagccatcaatatgggctttttttattttcatcttctaatcctcccgccgcaataattgggtcgttgcttgcttcaattgctgaagatcaaggtttgtcaacttagctgctaaatcagcatcccgtgctaaactttttgttaattctgcaatattagcaggggtaaatacttcttgggcggcttgttgccaatactgttcatctaggtcagtcattgatggcaacaaattttgctggtggagcaagaggtcatagatccaccatttaccattatctgcattttggtcctgcaggtgttcaaggacatccccatttgcaagcaggtgccgaatcgttggggaaagttgttcaatgttagcaatcgtcagctctaccagttggaaaggtgagtttttaagtttgccatcaattgcttgcgacagggatcgctccacttcagcaagattactagttgataaagcattaacggttagacttatccattcaatttccgcaattggtttaaattgcggcacaagtttattgccctgactttccactaaataataaccgtgctgtccggcttcatttttatgccgtccctgcggattaccgctgtaaacaattggcggcttctcattcaagaattggtgcttgtgaatatgaccaagtgcccaataatcataatttttagcgattaattcatcggtcgtaaacggagcatagtggttatcttgcctttgccggactgctccatgaagcatcccgatgtgccaggtttcgtttctttttgatggatatttttgtacttgatcttcttgaatccagcgttgatcataactaaagcctgagatagcaacactgtcatgatttgccaaagtaagagtggtggtcgttacgcgattgccaaaaatatgaacatttgctggcaactctcccgtgtcttggacaatttgataatcgtggttaccataaagtagataaacggggatgtgggcttgattaagtcgttcacattgcttgatgaaaaaatcagtagcggcaatgctttgctgatcacggtcataaatatccccgctaattaaaataaaatcgacttttaatgcaatcgcatcgtcaacaatcttttgaaaagcagtaaacgtcgatgagtggacgcgttcccataacggcttgggcatcgaagtcaaccctaaaaagggactatcaaggtgtaaatcggctgtatgaataaatctcataatttttcctcttaacaataaaggagctgagaaaaaatttgctttctcccagccccttacttggatcgtaataaattaattattcttgtcctggcatctttggcattacttcactgtaaagatcttgaattggacttgtaattgtcttattcaattgttgaagcatgctatcaacttgccgttcttggttcatcaagtcttgaacaaccttcttgccacttacttccttggcaaggttttggatgtttttaatttcatcatcagttggttgttgaccagtcatttgcttgtgttgagcatctgcttgagcttgttggaacttcttgaaagtgtcaaaggtgtcaccgtcagcctttaatgcttcaaaagccttttgtaatccttgatattcttgagtttcgcgcaattggcgactaagttcatttgcagtatcataaatatttacaaccatgtaaaagtctcctttatctcgttcttagattaattgtatcatattatcctagaaaagcgatcgaacattgctccaccattgactcgccttattaccaaaattatttactgattggttgaaattatttacaaagtcgtccccatctttgaggaatgatccccatcctttagaggaaccctttgtcttttcttttgcccgtgtttgagcatcttcaaccgtgaatttggttccagcagtatttggcaaaatcgcactcatttcattcttgtaaaggtagttaatgctccgttcagaaatatcgtttagggtgtggctttggtttgtatcatcatagccttcccacgttgcaaccactacatcgggcgtataacctacgatccacttatcacgatcattggaatcatcgccttttacccctgagtttgtagtccccgttttaccggcaagcgtatagccacttggtttggccgtttcaccagttccgtgatcaaatacgccaattagcatactagtcatctctttagccgtcttaccagaaatgatccgtttgtttttactaccatcatttttggcaatcacttttccagaggcatcctcaatcttggtaatgtagtgcggggatggcatcaacccatcattggcaaagactgcataggcacgagccatttgttgcggtgatactccgcgagtcataccaccgagggccaaggcaaggttcttatcacccttttcgactggcaagccaaacttctttgccatgtcataaccacgattgaccccgatcttatttaataaccagactgccggagcgttaagactctcataaagggccttatacatcggcaccgtcccgctataggtatcatcgtagttctttggcgtgtaattattagttccatacgattgtttcttatcttgaagcgttgaatcatagaaatatccatgctctaaggctggtgtatatacaacaatcggcttaatcgttgacccgggctgccgccgcatctgcgtagaacggttaaatccacggaagacatgttttccacgtccaccaacgaccgcggtaattcccccatttttcggattcatcgcaatcgaggctgattgaaccattgtgccatcggctgagttctgtgggaaattatcgtcatcgtcataagtttgctgcattgaccgctgctgatcctgatccagcgtcgtataaatccgataaccattattcatgatatctttttccgaaatatgataacggctttctgcttcggcaatgaccgcatcaaagaagtacgggtacttatagctgtcatttggcacgtagccgttggtaatattcaacggtgtttgcttatattgatccgccgcactttgactcagcttatgattttcaaccatcagctgaagaaccatattccgtcgttgcttcgtcgctgttggatgttctactgggtcgtacatccctggcgacgtcagcattccggccagggtagctgcttggggtaccgttagctgactggcgttttcattgaagtaacgcttagccgcatcttgaactccccataccccatgaccaaagtaggcattattgaggtacattgttaaaatctcatttttgctgtattggttttctacctcaaccgcaataaaaatttcccgggcctttcgggagaaggtctgttgttgagtcaaaaaggcattcttaaccagttgctgtgttaaagtactacccccaccagagatatagtcacggtgaagaagtttgtttttcactagtaagaagccagcccggcctaaccctttgactgaaaagccgtgttcatgatagaagttccggtcttcagtcgagaggaccgcgttaggaacgtttgatgaaatatcttttaattccacataagttcccttttgagcgtagaggctcccggccgattgattgctacgatcataaatcattgttggccgttgcaaccggttcttaagatttttaacatctgcagttttagcaacaaacgtcaaatggatactagtaattaagaaaattcctagaaaaataacaatgatccatcgcgttaattgataacgatgccagaactttttcagcatcgcaacaaagagctgccaatagtgcttaaaccaaactcggaatgacgcccaagccttttttaaccactctatgattcgctctttcaaacctgaattagattgtggttcacgattcattaataaatctccattttcatttcaaaaagctgacaattattttatcacattttggcaaatggtaagctattttctccgctagctttactagaaattaaaaatgaagagactagagaaaaacttattctctcaagtctcttcacaatacaatttagtagttataacaattacatctcatctggcgccttgatatcaagtaagtcaagggcagatttgagcacatcactaactgcttgagtaagagctaaccgtgctggttgagcttcgtccttatcaagaatccgagtgtgagcgtagtattggttaaacttcttagccaattcaagggcatacttagcgattactgatggatcgtagtttaatgcagcccgcttgattgcttcgctgtattggccaaggaagctgattaattcccaagcttcagcaccggcctttgtcaagtcaacatcactaaagtcccgaataccgcccttacgtaagatactctcagcacgagcacgagcatattgaacataaggaccagtttcaccttcaaacttaacaacatcttcaagcttgaagttaacggcattccgacggtagttctttaaatcgtggaagataacggcaccaacaccgacttctttagcaacttcatcagcgttttcaaggtcagggttcttttcggcaatttgcttccgtgctaaatcaatagaatcattcaatacatcttcaagggaaacaacattacccttccgcgtagacatcttcttaccgtttaagttcattaaaccaaaggagatgtgttcaatttgatcccaccagttgaagcccatttcctttaaggccgcacgtaattgcttaaagtaagtttcttgttcggcaccaacaacgtagagggacttagcatgaccatacatccgcttccggaaaagtgcagttgccaagtcacgagtgatgtacgttgtcgttccattactcttgatgattagcaatggtggtaagttatattcatcaaggtcaacaatttctgcaccacgactaggctttaataagtccttatcccgtaacaattggataggttcttccatcttttgagcagagaaagcttccccattgaatgagtcgaagttaacatctagcatcttataaacacgttggaaccgttcaagagaaacttcacggaaccagtgccaaagccgccatgcttcttcgtcaccatgttcaagcttagcaaaccagttacgacctgcttcagtgtattctggatgttcgtcagcttcattattgatccgcacatagtacttaagcaaagtattaattggatccttcttaacttccgcttcgtctccccacatctcataagcagccattaacttaccaaattgagtaccccaatcaccaaggtagtcaatccgaatcaagttgtagttaactttttcaagaatccgggcaacagcttcaccaatcatggttgaacgaaggtgccccattcccatcggcttagcaatgtttggtgatgaataatcaatcgtaacatttgattggtgaccaagatcaatctcaccataatgttcaggatctgctaagatagtttgcaaaatcttagcaccaacttgggctttatcaaggaagaagttgatatatgggcctgcaacaactaccttttcaaaaccgttttggtcaaccttttcaaccaactcacttgcaatcatttgcggtgccttatgtaaggtcttagctaagaagaatgtcgggaaagcataatccccattactagaatcttttggccgttcaatcttagcttcaatttctttaacatccatctctggcaatgcttgtgccaatgcagctgcaacttgttgcttatcgctcatatatattcctccttatacttataaaaaaacgcccctaataagcataatgcttactagagacgagatttacccgcggtaccactctaattgaattagaattccactcattcattgatttaattgaaatatctgaggcacgccttcacaaatcgaaaagcccctaactctcatcaacaaagggtcgctgtagatttcaaaatgctactactcctcaaatcctattttcatactcaattattataacaaatttagatttaaaaacaaggactaatctacaagggtgagttattgcttttttcttacttattatatgttacaattattatcattaaataataatgaaaggttgatgagttatttatgacaaaccctacaattcaagctgtcacaattgcaggtcatgattcggacgggagtgctggaatgcccgctgaccttcatgccttttttgcggatggcgtatatggtcacggtattttaactgccgctgtttccggaaattcttacgggatcacctcttcccaagtaatgccgcaagaatttattgccgaacagtttaaggtattaagtgaagattttgacatcaaagcagccaaaactggaatgcttgctaatgacgatgtaattaatgtcgttgctgataactattcgcctgaacattttggcccgttagttgttgaccctgtgattattactaagcacggtgcaatgttgcttgaacaatccgcctatgaactatttcgtgaacgaattattccccttgcaactgttattacccctaatttctatgaagcacaaaaattaacaggaattgaaatgaccacagatgaagaacgggttaaagcagctcattatcttcaagacttaggggcaaaaaatgtggtgattaagggcgcgcataatgatgatagccaaacaactgttgatgactttgttcttcttgaagacggtgatagcttctggctcaaaaaaccttttgttaagacagatcgattgaatggaaccggggatagtttctccgcaatcattgctgccgagcttgcgaagggaaataatgttaaaatatcagtaacaaaggctaaagatgccgtttacgcagcaatcgcaaatccattaacggttggtcataaatttggcccaatcaatcattgggatgcgcaaaaggagctgcattaggaggaatttttgatgcttgatacgtataggcacaaagttgtattaataggtgacggggctgtcggctcatcatttgcattttcattattgcagtcaacaaatgaggtcgatgaattggtactggtggatcgtacaaggtcaaaagcagttggggatgcggctgatcttgctgatattacacccctgacaaacccagtaaagatttatgcgggaacctatgaagatgctgctgatgctgacgtagttgttattacggctgggattccccgtaaacctggtgaaactcgtttagaccttgttaataaaaacactacgattcttaagtcaattattgaaccaattgtcaaaagcggattcactggtgttttcgttatctcgagcaatcctgttgatatccttacaacaattgcgcagcgaatcagcgggtttcctaaagaacgtgttattgggaccggaacttctcttgattcaatgcggctacgggtcctcttaagcaagaaattacacctatccgtcaatgtcatcgatgccttaatgcttggcgaacatggtgatacttcttttgcggcctttaatgaaatcacaatcggtggaaaggccctcaatacaattactgccctttcaaatactgataaaagtgaaattgaaaaagcagttcacgaagctggcagtcaaataattgccaataaaggggctactttctacggaattgctaaatgcctctcgtatattacacgggcaatcatcgaaaaccgtagtcttgtcctaccgatttcggctccgcttgatggacagtacggaattaagggcctgtacttaggcacgcctgccatcattaatagtcaaggaatcggccaggtcgttgaatatccattaacatcagatgaagttaaaaagatgcaacagtctgctgaagcgatgcatcaagttttagctaagattgagatctaaaaaagctgaggctaggagaaaattttctctcagcctcagcttttttataagagcgggtaacgagaatcgaactcgcgacgcaaccttgggaaggttgagttttaccactaaactatacccgcattaactaactaagttcaacacttagttagtatatacctcttctaattatttgtcatctgtttttaagatttttttgaagatttagcatcttctgctgtttcttcgtcatcctttttttcttcacgaggaacagcttttaccatcttagcttctttttggcgaataacagcgcggccatttaattcgttaaccccgcttttatcagacggatcaaaatcttggatagataccataattgaattagtataaaccttttcaacaacaccagaaaattcatgttcgaggggaccgaatttctttccttttacaatatcgccaatttcaaaatctgccacttgatttcacctcaaatattatttatttttacgcaagcaatatacgtaccatacactttttttattatattttcaagtcaaaagcatatagtcagtttctctcattaatgctaaaatcaaagccgaaaggagtttatccatatgttaaaaataatagtggcggtcttaatcattattttgattctcaccactaccactggtctgcatgcaaaaattgaacggaaagtgactaactggcttgaattaagccgtttattctttttccttttattgaccgcttcgattgtccacacctttcttcattttaaaactcagcttctgagcaacctagtatggatcatctttttaattctaatctatatcttaatggaaactgctttccgccttaaacgggaaacatttggcaatccctatctaacagccttactttttattgcccttattattgcctttgggattggctgctggtggatctaaaccaataactgttttcaatagtgtcaatcattttcactaactgactagtttcctcgacatcatgaactcgtaaaacacgaccgcctcgcaaatacattgctgtctcagcaatcaatgttacgccgagacggtcttcttttgctagattaaataatttttgaccaaaaccttttcgggatatcgcaaccataatcgggcgctggaggtaattaagctggtcaatgttgcgcatcatcgcataatcttggtaaccatccgcaacctttgcatacccaattccttggtctaaaatcactcgttcaagatcaataccagcagctgctattgtcccaagattgtgttcaaagaatttctgcatcgcgacggtaaggttatcatagtcatgggttcggctgctatgcatcgttaccattccaacatttgccttagccatcaaaattagtttttgttttgaattaaatgcctgcacatcattgataatatctactccggccttaattgccgctgccattactgggagtttatacgtatcaactgcgatcgcaatctggggatagttttcacgaagaagctgaatagccggcataattcgcgcaatttcttcttccggatcaacctctttaaagccacccggtttcgtagtttgcccaccgacttcaattacgtttgccccagctgccaccatcttagcaatttgactagcaatagcggagtgggattgaaatttacccccatcataaaatgagtcaggagttacatttaaaattccataaatcaccggttgctctgtcagatcaaaagtaaaccggcctgcacgccaaataatctggtgacgatggtaaacctgctcaagagaagcaattaattcttggtcgttctcccactgctctttcacctgcgctattagttcttttagggaaaggagcgggaaagaaaattctacacgcttttcaacacaagcgacggggctatcaaaatgacggataaattgctctaccattccagccgtctccacatctgaacactcccacgtcaataaaagctgctgatgacgattaacttggtcggctaagatcgcggacactaacttcgaatggtctttagtaactaaattttcagtaactttcatttcattctcctaattgatctaataaatttttaacagctcgtgcacgatgtaaataagaaatgcgggtcggctggtccatttcggcaagcgtttgtgattcgccagctggaataaaaatccgatcaaaccccgtcgcattgactccgcgttcggcatgagcaattgtcccctttaattgaccatgaccaattttaaccacttgattatttatcgccagggcaattgttgttttcattataaattgtcgtgacttaccatcgactaaatggatcaagtaatcatttaaatcaccatcgggaacttcttgggccaattcccgcgctgtctgcaccccgtaccttccaggaaaagccgggagttctaagccagaatcatcggcaattatttttgctgccggtagttgttgactgataaagagggccttctcctttgcattttcttcatagctcactgttgattcaggaggaaaagcttgttgcggcaacttttttcgatacccctcaccatgttggcggtaaaaatttagaatggtttcgatttctttaattttatgaatattatgggttgcaataataaaattatttttcatctaaattggcctcgatatctttaatcgtataaaaagaacccgttacaataattaaatcattcggctccgcaatcttttttgccaccactaacccttgtcggggattgttggcaataatcgcttgaggcagaactgattttaacgcacttgcatcaagggcgcgagttggatggtcaggagtagtaattattatctcatctgccatttgctgataaattttaaccatttgactaatatttttatcagcgagaaagccaagaaccataattactttattatgaggaagcttagaaatagttttggtaagttgcttggctgcatctgggttatgggccccgtccaaaataatagggggatgatcagcgattttctgcattcgaccagcaatcttcactgtcgcaagcgtcgataataaaggctgccaagaagtaacaagtcttcgttgataaagaaaattaaatacactgacaacggtgcccaaattttcactttgaaatgtccctaataaattaaaaggaactttataaattttatgattaactttcaggatcgcctttccatcaacaattgactgggcatctgcttgcgttaatcctactttttgctgttgagccttttctctaataattgtgagagcgtctttttcttggtgcggcgctaaaaacacttgtttagtaccggtcttgataattcctgctttagcctgggcaattttggcaatcgttggacccaaaatccgtgtatggtcaagggcaatatgcgttatcacactaataaaaggcgcgctgataatattggttgcatcatcttgaccgcctaaaccgcattcaatgactgcccaatccactttttggtctgcaaaatattgcagcattatcagggtccaccactcaaaaatggtaatatcatcaggtaaaagatcagcgggtaaatgttcggtgatcttttggtaagtcatcgcaaaatcttttttactaatcaaatggtcattaaccttaatttgctcccgatcatctaccaaagcaggactgctaaaatagccgacccggtagccagcattttgtaacccctgttctaacattgtcccagtcgagccttttccgtttgtccctgcaatatggataattttaaatcgctggtcagggtttcctaaacgagtaagaattcgtcgcaaaaattttacccgatcccgttgtcctcccagcatttggcgattaaagcccgcgttaatttgttcataggtccgcacgataattcctcgtttgatttagaaattcttgtttcaaatcacggtcagtcttaaattgacctgtaaacttatcagtataagtaaattgaccagccttattcacaccccgcatttccatacaaaggtggcgggccgcaatggttactgcaattccggctggatcaagaattcgttgcaactcggctactaaatcagttgtaacgcgttcttgcatccccggttttttcgttacaaaatctaacaaccggggaattttactaaggccaataacttttttatctttgggaacataagccacattcgcgtatccgaaaaaaggcagcaaatggtgttcacacattgaataaaaaggaatgtgttgcactaataccatctccggcacatcatcaacatggaaaaccttatagttggccatttcttctggttgatgattaagagaagaaaaaacttcttggtacattttggcaacgcgttggggtgtctctgccaatccttctcgttccggatcttcaccgattgcaattagtaaatctttaacagcctttgctattttttgttggtccatgaaaacacctctcgtccatatatctttttaagccaattatggtctggagtcttatttaacaaatgatccaattgttgataataaggatcattttgattagtaatttcgcgcattggtaataaaacaaactgccggttagccatttctggatgagggatcgttagcgttggtgttttgatatgttgatgaccaaaatcaataatatcaaggtcaattgtccgtggtccccaatgaataagccggcgtcgatgtaactcttgttcgatattgtgaaggtggtcgaggagttgctgagctgttaacttagtcgcaaccttaactgcaatattgtaaaaagaatcttgtttgacatcccccaccggttctgtttcataaactgaggaaatcgccataatatcaattttaggtggcacattcaacagctgaatcgctttttgaaggttcgctaaccggtcgcccatattactgccaatacttaggtaggcttcagtcataattacttgccccctgctacttcaatttcgacattatcgaaaattccggcgatcggcacactatactttcggatgcgaagacgaattccatcaagcatcgggtaggtcttgaaaagctcatgtaataagttattagcaagactttcaatcaaattgtagttatgatgagcaacaaattccgcgatcgtttcataaacatcagcataactgacagtttcctctaattcatcggttttaaccatcgtttcaattgggtagtccatttcacagtcaatttcaattttttgaccaagctttttctcttccgcaaacacaccattgtaagtattaaatgccatgttgttaattctaatctttccgataagctattgccccttcattttttattttctatcataacgcataagttagttggtgaaaatatcttaatagattaagggcgcaatcttttcctggtaccattgttccccagcttttgagaaaggattagtaaacggcgcaggtttaatcaagcggtcatcgacgttaaacaattttaactgtcccttaacttttaatggttcaatccaataagaaccaccttcctcaaagggtgcaatcatccatgcataatatttttgttcaccgtcatatcgttcctcaattccagtgatcttagcaacacataacgcgtgaccaactaccgacccacgtgtcttcttcgcactattgcaaattaagaggtcaccacgatacttagttgtccatgtccgatattcctctgtttttgtgccacttaagatttccattccatattcgggatgaattgataaagctttcatcttgctcttcctttgcagttttatttcaatataaagaaaaaagcccggcaaattaatgtttaccgagctgttatgatgcttcaggcaggattcgaacctgtacatggataaccatacaacgacctgaacgttgcgcgtctgccaattccgccactgaagcactaactattttgtaacattattaagtataccgaactcatcaaaaattacaagtatttttattggcaatcctcaatttactcttatttaacaaattgaatcattgttccatatgcggttaagaccaagaattttggtgcaacctgcatattagcaacatccgtagtaaaacgaaccccaacaacaccatctgcacctttttcactggcccgccgctttaatttttcttgaacatcactaaataattgatccatggactcaaatgaatcaattgcttcggtaggcatcgccaaatgactggtggcattaacaatccctaaaattcggtgagcttgtggaaatccctcggttgataaaaacatcttgctatcctcctaaaatcactaccactttaaaataacaaagaggccggaacatttccagcctctttagtttattgcggaaagaatctgctactttgctagagaactaattattaattcattttgattctaacttccgcaaagtcgcatttatatcatcaacctagtgcaccctggtgaccttattacataaatattcagtctaagatttcatgtcacacttatgttgcttctagcctactattaatttcttcggtgctagattgatataagggatcttaccactctaatctttccacacttataatgtaccactatctgtaagcgatttcaacgattaactttagacaatttgagctaagagaacatacatcgcaatcgcattattaatcatatgaatcgcaattgaatttcgaatgtcgtccgttcgcaaataaacatatgccaagaccatccccatataagcatacatcaaaaagctaatggggttagtactcatatgtccagtagaaaagattacccccgagaggataactttcggccaaatgttgccacgcttaaagaacatatttgtcaatgtaccacgaaaaataaattcttcagcaattggacttaaaacaactgccgagaaacaaaatacgatcgtgatcacttgattatggccaagcatacttcccaatgccgcgttattagctgtctcagtttgatgatagataagttggttgaggtagctaaggacatccattcccaaaataattgctaggtacccaccgataatccaaccaacctttattcccgctggctgccctaattggttataagcttcatatgtccggtgtgcccaccaaataatcgctaacattaaaccgatgaataaggccataaatccgtccacaataagctgattggtttttgaataacgtaaagcaaaattaactgccatcgggggaacttcaattgcaattagcatcagtgcaattaaaatcaccttagatgtccactgtttaattacttttatcattatttttctcttcctttgcccgtttctcacgcattcgttggatactccaccgggtagaaatttttgtcacaatgatatttgcaactacgaaaccaattacccagagaaggtacatcacccaaccagaaatataattttcagcagtcaaccatactaaaagcgcaaagatgataaacggcggaatgaccaccttaagaataaattctgctttcacaaagaaaacctccattattatttgtccaacagtttactaaatcaacatgtaaagtgcaagggtactaagaaggctgagaaaagttttcgctttcctcagcctcaccatttttaatttatatttaactaaacctagttattctttgatgcagcaactacttcgtcataagtaggaattgatggtaatgcaccaagcttttgaacagctaatgaacttgcccgttgagcgtaaacaattgccttttcgatgttgctcatatcaggctttaattgggatgaaagagcaccaatgaatgtatcaccagcggcagtagtatcaacagcattaaccttaaaggcaggaatgaagttgtaaccatcttgagtacagtagaaggcaccttttgctccaacagtaataattaaattacggacacccatttgagcaaacttagcagctgacataagcattgaagtttcgtctgtaataataatccctgttaaagcagcactttctgtttcatttggaatgattaagtcagttaacttcaataggtcagggttaatttcatgagcaggagcaggattcaagattgtctttacaccattttcctttgcaatttggaatgcccgtaaagtagcttcttgtggtgtttcaaattgagcaatgacaaaatcggcagcagcaatttgatcgcgagcatcttcaacttccttaacgcttaattgttggtttgctcctccgtatactaagatactgttttggccgctttcatcaagtaagatggctgcagatccagtacctgcttgatcgtcaacatggatcccagttgtgtcgacgttgttattcttgaggtcattgatcatcatcttaccaccagcgtcatcaccaacttgaccaacaaatgctgtttcagcgcctgaacgtgcagcagcaacagcttggtttgcaccttttcccccggcagcattagttttacttaaagcggcaattgtttccccaggtaatggcatccgcttaaccttcattgttgtatcaacatttaaactacctacaattgttacatgatttgtcatttgtttatttcctccttaaacaattggcatctaattgataatatcatcataccatattattttggacgataggaacttgtactatctcgtttaattaattttaccggaaagttttgcacacgggcttcagcactactatgactaatctgttcaatgagcattttagtagctcccgcaccgaggttaaaaataggctgttgcaccgtagttaatcggggataaacataatcatcccagtagatgttatcataaccaatcacagaaatatcttcaggaaccttaacgtctaattcatgtagcccccgcaacaatccaattgccatttcatcatttgccgcgaaaacagcagaggcaccagttgctaaaacatcttttaccgctttatatccgccatcctttgtcaagggtgcccgaataacatcgtgaatcggatctaggcttagattattttctttaataatatttttaaatccattcattcggtgatttaagttttcagtaggattatcagaagtaagaacggcaatatgtttgtgaccaagttcaatgaggtgcttagccgcaatttgaccaccaaggtaatcattggtttgtacccggtcaccctcctgcgtatgattctggtcaaataaaatataaggaatttcattaaaggagataacctctttaattgtctcagtagtcatcgttgcactagcaattactaatccactaattgatcgttcaatcatctgggaaaggtaatatttttccagctttgggtcacggttggcactaaagacaagcggaataaattctgcttcacgagcaatactctgtaccccttcaacaaaagtaccaaaaaacgggttggcaatattaggaactagtaccccaattgtcttggcgctctttaaaattaagttacgagcattaaaatcaggaacgtatttatacttatcccgtaatgccaaaactcgttcttgagttgctgtactgaatcgatcacctttattatttaaaatttgcgaaacagtggttacagaaacaccagcttcttttgctaaatcacgaattgttattttctttttcatggctgttcaacctctttagtaaacagttttatctagttaataatatttaactaatttaaactatctcaactcatattgcaatcacatttcattaaaaatatcattaaaaatctgtttcccggttgccatttgagtcccacgaacgcggaggtaatcaatcttagctcgcaaaatatcatattcccacaatgaagataggtcatggtcattatagtaatgaattgttaccttaatgggcgtaagatcagtaattatccctgtaaaatcatcactccccttatacttttcagtgccaatcacaactggaaggcggttttcataagaatcattgagaaggtttgacaataggttcccttgagtaatttctggatggttatcgataaacttttgcacttgccaaatatcaaaataattgtaatcatgggcaactttagtcttttcagaaaccgtcattagataatcactgtgacgttccgtataaaggatgctcttaatccgaatagcaattagtccgttgattttaccgtcccagtcaatactgatcattaagcaaaataccgggtcgagggcaaccacaaatccgacattaaaataatcgtcatttggcaagttatgaacctcaatcaacgttccctgttgcttagccattgttaattgaacgcgattctcactttcactttcttttctcatctttacttccttactattaatttttcacatgattagatttttaaaatttaatcacatctctattcttattataatcgctaacaatgtggatgtgataacttttaccacgataagttaaatctaggaaccaccaaatattgtaaaattaggtgtgtcattccacaatattttgtagtaagatattttttgtgacaaaaaagtaaagaggggccattatggtgattattacagcagggatgattggtgtcggtaaaacaactttaactgggaagattgccgaacacttacatacaaaagcattttttgaaccagtcggagaaaatccagttttaccactgtattataaaaatccaaaacagtacggctttttactccaaatttattttttaaacaagcgtttctcaatgattaaacaagcccttactgatgataacaatgtgctcgaccgttctatttacgaagatgccttgtttacacgagaaaataacgccgagggaaacatcactgatactgaattagaagtatacttaaagcttctcgacaacatgatgagtgacctccaacagttacctaagcgcgcaccagatttaatggtttattctgaaactgattttgaaaccatcttataccgaattaaaaagcgcggacgggattacgagcaaattgatactaatccagagttaaaggattactattacaagatgtggagtgcctacaagcaatggtacaaggattacgatgctagtccaaaaatgaaaattgatttagagcgttatgatcttgaagatcctaagaacgttgatgcggtcttagcaatgattgatgaacggttgaagtcattacgctaaataattgataagagcatgattagaggtttgccttttaatcatgctctttccttttcttcaacaaacgacgaaacatttcaatcgttcctgccgtccctactccaccaagcaaaggaacatattgagggatattaacatcgttctttcgcgcttgaacgggatgtttgacaacaattggcatcgcctcactctcctctttcctatctgtcattggaataggattagcccgttcattgctggtgttaacttgatcatcgtatttagtaagttggtaagtatcaatcagctgatttagcttccgatcatactcgggatctgttgcatatcttccgcaaagtgcccgcgtagcttcacgataatttttggtattttgacgatgaactccttgataaagtggggcttctaatgtttgcgcataatctctcaatgcttcatattcacttgcatactggcgaaaattactaacgacctgaaacttatgtccttgttcgtcatattcagtcgtgggttgagcaactgtttgccgggcaaaataacccttaaccccaaaaagattattattaggcgcctttcccaacgtactgcatccccagtcgctctctaaggctgcttgcgcaataataagtgatggatacaaatcatattcccgaccaatttgttgagcagctggggctattcgattaataaatcgtgcttggactgcggatggttgttgaggttgataaacctgctcatcttctttaccttctagcagctgcctttgttcagcagagttttcagttgaagattgaatagtttcatgctctggcgcttcctctgtacctgtcaaagcattattttgctcattttcctttgcttgagcagcattttcatattctgttaaataagcatcaatatattcttcatcatgattaactaaggcctcttcatcaatcggctttgcacgtttcacatcttcatttgcatcaaattgtgcttgttggatagcgtccgctttaatcggttgcccattaagacttgttaaaacaattaatgcactcgtaatagcacggcggtttaacacaataaaacactccttcataatgtcctatagtatatatacgtgaaaattatgaatttgcatttttaaactagaaaagactagaagaaaattcccctagtctttatgctttacatttcaggatatgtcgtttccttaatatccaacttttgattcttcaaatttgtcttaacaacggtaacgtcacatggtgcttcacgaatagtataagcagccgttgaaccaacaagcagacgaccgacaacatttaatccggttgcgccaataatgattaaatcaatatcattttcttttggataacgttctgcaagttcaaccttagcgttaccaacttttacatcagtttcaacatcttttattccagcagcttctgcttttttcttgtagtcagctaatttcttttgcattgtttcaattgctgaatcataaatgctatgactaacaaagccgtatccaccaggaccagtacttggataacgttcaccattgataatacttaataagtacaatttagcatcattggtcttagcagtgtcaaccgctttttcaaaagccatatcagcttgctttgaaccatcaacaccaacaagaatattttgataactcattcttgacacctccattttgtatccttattttagcacaaaattaatcagtaacgagattattaattgcctccatgtaaatcgccatcgatgtaattaaatctttaacaggttgatattcattagcctgatgcattgtatttggcgtatgtggcattaaagcaccaaaggcaacgccccgcttcatcaaacgaccataagttccaccaccaacgacttctggttttgcgtctgtatctccagtttggtcaatataagcttgcatcaatgtcttaacgattggatcatctggatcaacataatgtggagcttgagatggaccttgtgtaactttaatttgtaatttgtcggcaatcgcctttacagtatcctctagcttatctggtgtcacacctttagggaagcggaagttcatgtcaatgtggccacccttgtccgcatcaaagtttaaaattccggcgttcatagttaattcacccattaccggatcagtgtaagcaccattaaagccatccatccgcgtatctaaatgaagataatcagctaagaattcaatgaagctctttgcgcctccaccaaagtcatatcgatttaagaactttgcaaggtaggttgctgcattgattcccttttctggttccattccatgcgcagcttttccgatgacagtaatcttaagccccttatctgttgattcaatattaccttcaaccgggttttcttcaataaagtggccaaaatcattagtaacttcttgagggttatccgtccgcatgagggcaactgcttcccgcggtaccatgttgaaacgtaagccagattcaaaactaactagttgtgttgaggcatccccattgccagcagggacatcaagcaagagcgatacttgacccttttcaccgttaattactgggaattccgcatctggtgaaaaaccaaatgttggggctggctcaacttcaaagtaacggtgcattccagtccagttactttcttcatcagttccaacgataaaacgaactttcttgttaaactttacgccttgatctttcaaatacttcaaggcatagtaagcggccattccaggtcccttatcatcagaagcaccacgaccatataagttgccatccttgataactgggtcaaatggatccgtatcccaacccttaccagcaggcattacgtcaagatgggctaaaatagcaagtgtttcatcgccttcaccccattcagcatacccaacaaggttatcgatgttctttactttaaaaccgtcttgttctgccatctctaaaaatgcttttagcgcttgcgcaggacgagggccaagcgggtattcatctgttgccgccgaatcatcacggacactggggatcttcattaatgctacgagatcatttaaataattttctttttgcgcctctgcggctttcatccaatcagtcaagattaatccctccaaaatattctactttgactaattttaatgataccattaaattgtctattaaataaaataataaggagtcttaactgtgaaaaaacttactgaccaaatcttaaaggatgttattactccccgtcctgaaaacagttttaaaggtacttttgggaaagttactcttatcggcggcaatcgtaattttggtggcgcaatcatcatggcatcaaccgcggccgtctgtgctggtgctgggcttgtaacaactgctactgatgaaatcaacgctagtgccctccatgcgcagttgccagaagcaatgttcgctgattttactgatgatgccctagtcgctgaccttacccaagctgctaccagtgtggtcgttgggccaggcctcggaaatgatggaacaagtttacgaattttgaaaaatgtttttgctcatacgaccgagaaacaaaatgtgatcattgatggatctgcaattactcttatggcgatggaaaagcttgaacagccacaaggaaatatcatttatactccacatgaaatggaatggcaacgactctctggaatcaagattggcgatcaaactgaagataagaacaaggcagctcaagaaaaactcggtgctaccgttgtcttaaagaagcaccacacagaaatttatactgatgaccaagtatatcagttgccaatcggtacccccgcccaagcagttggtggaatgggtgatactcttgccgggatggtgggaggcttcactgctgaatttaatgaaaaggcagataaggccgtcctcgctgcagtttatgcgcacagtgcgattgcggaaaagatcgccgaaagccagtatatcgttctccctcaccaaattagtcgtgctctcccagccttcatgaaaaagatggaagggatggatgaagaccaccatattggatttttgaattaagaatttaaggatattaaaaaggttcagagcaaatcctcactctgaacctttttgtgtgcattgttatttaatgtgtaaaatcgttcgtaatcttgctactcgtggtcccaatagctggtcggctaatcgtgactttaagcagagatagagataaattcctgctccgactattactcccggaatcaaggagaagaaagcagtgtagcgcccatatggactaacaaaatggccaatgattaacattacaatctttgtcccagcaaacatcactaaggagtaagctaaaatctggttagttggcagggccatcttatcaaaacgtaggtggaattccatattaaaggaatgcaagatcaaatagttaatcacaaacattgaaatcccagttgaaaccagtggtcctaatccttcaaagatccaaatacatgggaactggaggataaatttaattacgattccgatggctaagaacatcatcatcttcttattctcagaaattccctgcatcattgctgcggctacagtatacaagcctaacatgatcgaaatgtaagctgcaaattgcagtactacgacccctgccgcatcataacggtaaaagacggtgtagatttgctgagcaaccgcggataatccaagagctgccggaatcatcacaaaatagaataacaagagaacgttttgaatctgttttcgcatatcctcttgatcgttctgagcccgggctgtcgcaagcaacggaataactgttgcagctaatgcagaagctaatgaaataacaatcatgtaaagcttattggcattaaacgcgaataaggcataagtaacatccatctggtacttagtaaagtgaccaactaatggcatcatccgcttaaaagtgtattggtcaattaattggaaaatcgttacccctgattcaataatgatgaacggaattgactgataaataatcttaaaaattaatgtttgggttgaaacttcagtatttatttcaccatgtgccaccaagtcattcatttcacgttgatgacgcatccaggcaattcccaagacaattactgcaccaattgccccgataaaggccgcaaaggttgattgggaaacggcgctaacccaattaccattttgaatcttcatgatgaaataagtagccgccagcatataaataactcggaaaagctgttcaacaaattgcgaaattgctgatggtgccatccagttatatccttgtaaaaatcctcgggtaatcgacatccctgggataatcaaaatagcccaagctaacgagcggataaccggaatcatatttggatctccgttatccattaaacgagccccaaacatcatcactgtcgtacaaattacacccattgccattgcaacgtacattccagaatgatacagtcggcgactaacgccatactggtttattccgttataatgcgcgaccattttagaaattgcagaaggaattcccgccgttgcaatcactaaaaacatattataaatattgtacccttgagcatataaggcattcgcttcattactgtaagctcctaaccatgtaacccatggaataatgtacagcgcccctaagatccgcgaagtaatactaccagctgtcatccaagctgatcctgtaatcatttttgttcgcgaatcttttttaactgcggtgctgctcaaatcatttactttattttcttccatgatttgttgcaatcctaccttttttattttaatcgagtttacacaatcttaatcattttatcgtgaataaaaagctggtgcaattcgatttaccgtttttaatatttctttaacctagtattgttccaaatcaacagttaccattttaatgatttgatctggatgttgttgctttaacgtctctaatgagcttacggctggggcatcttcaaagtggccgagtttatcattaagggtaatcgctaagcccaatttagcaaaatccatcgcctcatccattgttttcccctgagtaaatgcttccggcaaatctggaaaatcaacttgaatttcattatctttcggggtaaaaattgctggataactcactatttccataatttatatctcctcaaataaaaagaagcaggaaaacatagattccctgccctttattaatttactattttgcaacgatgttaacgatcttgttagggacaacaatgacttttttaatatccttgccatcagtaaacttcttaacatgttcgtttgctaaagcaagttgttgtgcttcatcgcggtcagtatccttggccatcttaatcttagcccgtaccttaccgttaacctgaacgatcatttcaacttcatcttcaactaaagcttttggatcgtaagttggccatggttggtaagtgattgtatcactctcaccaaattgactccagagttcttcagccatgtgcggcatgattggtgcaatcatctttacaaagcctttcatgtattcaactggtaaatcatcaaccttgtaggcttcgtttacaaagaccatcaattgagaaatagccgtattgaagtgcatccgttcgtagtcttcggtaaccttcttaacagtttgattgtaaaccttggtaagcttaccatcattgaaagtggatacccggtcacggaggtggttattatcatccatcaacaaccgccatacacgttgaacccacttattagcaccatgaagtcctttttcatcccaaggtaccgattcttcaagtggtcccatgaacatttcgtaaagacgtaaagtatcagccccatattggtcaacaatgtcatcagggttaacaacattacctttggacttcgacatcttttcatggtttgaaccaagaatcatcccctggttaacaagcttcatgaatggttctttagttggtacgagaccgaggtcataaagaaccttatgccagaatcgagcatagagcaagtgaagaacagcgtgttcagctccaccaacatagagatcaactggtgaccagtaatccagggcttcttttgaggcaaattcctcgtcattatgaggatcagtgtaccgaagccagtaccatgatgaaccagcccattgtggcatggtgttagtctcacgaagaccatgacgaccattttcgtcataaacgttaacccaatcttcaacatttgctaatggactttcaccagttcctgatggttcaatgttatcagtctttggcaattcaagtggaagttcatcttctggaactaatgaggttgtcccatcatcccagtggataactggaattggttcaccccagtaacgttgccgactgaagatccagtcacgaagacggtagttaaccttcttgtgcccagcatcgtgttcttcaagccaatcgatcatcttttgctttgcatcagcaatgtttaaaccatcaaggaagccagaattaatgtgtttaccatcgccatcaaaagcaccttctgaaatatctgcaccttcaataataggcttgattggcaagttaaacttagtagcaaagtcataatcccgttgatcaccggaaggaacagccattactgctccggttccgtaagaggcaagcacgtaatcactgatccaaattggcagtttttcaccgttaactggattaatgacgtaagaaccagtaaataccccggtcttatccttatttaaatcagtccgttcaaggtcagaccgccgtgatgcttcttccttgtacttttcaacttccgccttgtgttctggcgtcgtcaattgatctactaattcttgttcgggagcaagaacaacataagaagcaccaaagagcgtatctgcccgcgtcgtaaatacttcaatcttagtatcttcatcccccacaactgggaaaaatactgaagcaccttctgaacgaccgatccagttacgttgcatttccttaacgctttctggccagtcaacaaggtcaaggtcatcaatcaaacggtccgcataagcagtaatctttaaaacccattgacgcattggcttacggtagacggggtaaccaccacgtttagtcttgccgtcttcaacctcttcgttggcaacaactgttccacccataaaatcaggggcccagttaaccataatttcactttcgtaagcaagccccttcttgtagagctgttcaaaaatccattgagtccacttgtagaacttaggatcagtcgtatttacttcgcggtcccagtcatatgagaacccaagtgattggatttggtcacggaaatggtcaatatttttgttcgtaaagtccttagggttgtggccggtctttaatgcatattgttcggctggtaaaccgaatgcatcccaccccattggatgtaatacattaaatccttgcatccgtttcatccgtgacattacatccgtagcggtataaccttctgggtgaccaacgtggagtccttgaccagatggatatgggaacatgtctagtgcatagtatttcttttggtccttattaaggtcggccttgaaagtctcattcttcttccaaaacttttgccactttttttcaatcgtcttatgatcgtaagccatattttctactccttattctgattttgatgatcgtaataaaaaagtcccgtagaaatcaatctacgagacgaaataactccgcggtaccacccgttttccatggaatccatggcgcttaagaccttaacgcggtaaacgtcattacctactaaaattcagtaataatcacatttagatgagttcgtaaatgaccagtctcctgttcacaccaccacaggatctctgctgacctcgtcaaatactactatttctattacgatcaaatatttaacgcttattttaacaaccactgttaatgattgcaagtgtgtaactaaattattagcctaaaatttcttttaattcgtcaactttatcaaggtgttcccatggtaagtccacatcagtccggccaaagtgaccataagcagcagtttgcttgtaaattggccgcttcaagtcgagcatttcaataattccagctggacgtaaatcaaatgcttttcgaacagcggcaattaattcttcttctgaacgggtaccagtaccataagtattaatcatgattgatactggttctgcgacaccgatggcataagcaacttgaatctcggccttcttagcataaccagctgcgacaatgtttttagcaatataacgcgcagcataactagcagaacggtcaaccttagtagcatcctttccagaaaaggctccaccaccgtgatgagcagccccaccataagtatcaacaataatcttccgtcccgttaaaccggcatccccttgcggtccaccgattacaaaccgacctgttggattaatgaagtacttagtttggtcatcaaggtactcagctggaatgacagcttcaatcacttgttctttaatatcctttttaatttgatcaagtgaaacctctggatcatgctgggtacttaaaacaacggtgtcaacacgtaatggcttgtcattctcatcgtattctacggttacttcggcctttgcatctggacgaaggtaagagataacgccatccttacgtagttgagcaatcttacgcattaacttatggcttaaaaccaatgttaatggcatatattcaggtgtttcgtcagtagcgtaaccaaacatcaatccttggtcaccggcaccaatcttatcaagcggatcagcttcaccttcacgcgtttctaaggagtcatcaaccccttgcgcaatgtctggtgattgttcatcaatcgcagtgataacagcacagttatcagcatcgaaaccgtacttgccatctgtataaccgatcttacgaattgtgtcccgcacaatctgttggatattaacgtaggccttagtagaaacttcaccaaagactaatactagtccagtagtaactgaggtttcaactgcaacccgtgaatcaggatccttcttaagcaattcatctaagatcgcgtcactgatttggtcagcaatcttatctggatgtccttctgatactgattcggatgtaaataaatgtcgttctgccattttctaattcccccatattctattgaaactttcaaatagtttgtagttgcggttacaaggcatcttcacgttcagacgtgaatcctatcgggaattgctttataacgagaataatcttagcataattgttaaccaacaatcaatgttaatccagacattcttacttcaaacgggcattgaccatccctaccgctgtcatgaaagagtaaataattgtcggaccaacaaatttaaatccatccctccgcatttgcttagctatttcttccgaagcaggtgttttaggagctaattcaacatcggtagttaaccccaagtcttgtggctgatcatcaacaaagtgccacacataattatcaaacgtctttcccgttttcagtaatcttaaaatcacttgtgcattattaattactgctactattttacgacgattacgaataatagtttcatcctcacataatcgattaatatcttcatcggtaaaggatgccactttttcaatattaaagttcgcaaatgcccgattaaatgcttctcgtcgccgccagattgtttgccaagttaaaccggcctgaaataattctaaagaaagcattgcaaataactgctggtcatcatgaactggaaatccccagtagtgatcataatagttttgcatttccagtgtcgaatttgcccattgtggtcgtttaagtgtcattattaatacctcttttttgattttaaaataatagaatcttaagcataattgccggatgcgatgaagggcggccggtagccgctcctgaatcttctaatagcacatcttgtggaatcgagtcgacaaaatcactaattagtcgcgcaacatgattctgtggtaaatcatagttatagtttagtacgaattcggtttgccctatggtataattttgatacatggaaatcgctccctttggttgtttttaggggtaattacatcatatcaggaacgatttcctgtgtacataaaaaccggataatgaattgtttgaacaattcatcatccggtttttattttggactaggagttttttcccagcctcggtttttattttggactaggagttttttctcctccctattttatatacgaatttttggttattttgtacttttttctttattagtattttttagcataaatgctagtatgagcccaatcaattcagtgatgatcatgccgataaataccaaatgatagccgtgaagggaagcaacttgcgccgaactttcccgttgaagtgcatttgtagtagcaaccgttaaaatcagtgttgaaatagtaacgcccgcggaaccgagaacttgccggacagttgttattacggctgttccgtgggggactaattcatcaggtaaggcatttgctcccagtgtaacagctggcatcattacaaaggcattgccaccctcaattaccattgcgcaaaggatcattcccaataagctgaggtgattaaggacgattaatccagcaacccagccaatgataatcataaacattcctaccagcattgtcggtttaaacccaattttatcagctaattttcctgacaaaggattcaggatactaagaaaagcagcgccaggcactagggccatcccagaaacaaatggactaacttttaatactccctgataataaagggggaaaataattgtcgttacaattaaggcaatatatgaaatcgacgttaaaagaattgctaaatcataattaaaagtcttcaatacccgtaattccaatagcgggtgtttgagacgaagctgtcgaatacagaaccagataaccgcaataatactaacgataaagatccctgcatttattccccatgcaggattcttttttccggtttggtcaacaacgtacataatcccaattaatccaactagtaagattactgatagccaatcaaggtttgtttcatgccgttccattacgtcttggatcaatccgctagcagccattaaaataattatggaaataacaagcatgaagaggataaaaaggctcttccagctaaagaactttagtacaattcctgaaacaatcggtccacaggcaagggcggatcccattaccaaaccagcaattcccattgttgatccccgctcttctttaggcgtaatctcaagcaaaacggtttgatatgatggaaataaaactccaacagcaaatgcttccatggcccgtccaatcatcataaaccagaagccattaattccccaagatgcgggggttaaaacaatcatcaaggatccaatatcaaatagtcccagtgctccaatgaacattgtcttaaaactcatattattgagcatccacgggctaattggcatgctgacacacattacgagcataaaaccagttgtcagccattgaacggttgatgctgaaatcccaaaagcattcattaaggttggataggcggttgacaacgatgattgactaattgacatcgtaaaggtaccaactaataaagtaaaaataaaccaaaagcgactatatctttttccattacgtgcgatactttgatccatatcactctctccctctttagaataattattatctgactgttaattattatatgttttgaattagtgaatgtaaatgttataatatcattagattataattattttaagaaaggggacgacattatggcagaagcagaatttgatcgagctcttgatcatctccgtgaaaacaaggtccgtcttactccccaacggaaaaccatcttaaattacttaatcaatcatcatactcatccaagcgttgaaatgatttatgatgatcttaaagactcagttgccaatatcagcatggcaactgtatacaataccctaaagctcttcgttgattacaatctcgtaattgagttaaaaaatggtgatggtagtacccactttgactatttcggccatccgcattatcatgtcgtctgcgataattgtggtaagatttctgatgtttttgatgagcattttactgaaatcacgaaagaattaacggttatgactcatgaaaagactggctacctagttacaggaaataacatcgaagtccatggcatttgtcccgagtgtcaacgtaaattacatttgaatcgttagtaaaaaattccccgagttttcggggaattttttatgctttcttttgtgttaatgaagcaacggcaagaattgcaaaccaagctaaagttagtataagcgcaattaaagtttgtttctccatacataaaacaattagcacaataaaaagaaaaactaaaataacatagtcagtaaaaggtgcgcctggcatcttaaaagtccttgattgcggatgctgacgaatatattttaaatgcgccaagatgatagcagcccacacaaagagaaaactcgtggtagcaatactggaaacaaaagtaaaaactccttctggtattactaagtttaagatagcggcaattccaataacaactgcagaaataataaccgctgttgcaggcaccgaccgtttagataagcgactaatcttacggataacaggccggtgagcagtagaggttaactcagccagcatccgaccagttgtatatagagaactgttacaagcagaagccgcagcagtaattactacaaaattaacgatactagcagcccccggaagaccgatgtcgcgaaaaacaaggacaaatggactattgcttggtgaaagtttactccacggataaatgcacataatgacagccaaagcaccgatataaaaaagcataattcgaacgggaatgccattaatcgccttaggaataacaactttaggtttttctgcctcagcggctgtcacccctaccatttcaattccaacaaaggcaaatactaccatttgaaaagaaagcatgaagccctttgtcccggtagcaaaaaagcccccatcattaactaaattagcaggagtagcgagatagccgcttgccgaatgaaaatgaagtaaaactaaaatgacaccaacagcaattaaaataacaattgccaaaattttaataagggcaaaccaaaattcgagctcaccaaacgtactaacagtcattagatttaatcccagtaaaattagcagagttactaatccaggtaaccattgcggaacttgaggaaaccatagttgaaaatataagccaatggcggtaacttcggccattgccaatgctagccaacacacccaataagcccagcccattacaaaactcacgcgattaccaagataatcacgaatcgcatccataaacgaatgataatgtaagtcggaaagaagcaactctcccagggcccgcataattccaaaacaaataatcccagtaattaaatatgctaaaaggattgctggaccagcagcgtgaattgcctttcccgatccgagaaataatcccgtcccaattgttccaccaagtgccattaattgaatatgacgacttttaagtttacgtgtaaattcttgtttttctgccatgatcctctctcttcctcaataattgaagttttattaatcctagttaggtttactagtcattactaaaaaaatcaactatgatatataacattgaaaacttattgtataccatttttcgtagaaggagaaatcacattgcatgcattagttcactggatcccattttttatttatttctttgcaggatctgttctcgtcactcataatcacctttgggaaaaattccctaacttcggccagcacattacaattgcaaccttttttatctacttaactgcaatcgactggctctgcttaactccttcaatgtttaattttagttctgctaataaacttttattttactttcatagcgtaccatttaatatcatccccctccaaggactcagccaagaattcttcttaaacattgtgatgactttgccgctaggagtttatctttatttaattaatcaccaaatgcccttcagtcgtgctattctctacggctttttcttcagcttatttatcgagtgtaaccaatttgtttgcgaccttcttttccatattggaagggttgccgatgtggatgatttgattagcaataccatcggaactacaattggttttgcagtaatgatcatacttgatcaaacgatttttcatcaagttattaaacaatttatgctagtgggtggaaaatctgataaactgaataactgaggtggtaaaagatgattacaaatgaacaaagagcgcacgatattgctcttaccttactacaatcacgagcaaaagatctaaagccaatcgaagcgtatcatgaatatgttaattcattattaccaatcttaaaggagattgataaggactttcccaacggtattaaagagcacctttaatttcccgggaaattacgacaaaagccggaagaaaaaacttttttccggcttttactatttcaacttatatattgtcataactactttgttgagatttcctttcttcttgttttatcaacctatttgaactatgatattaatgattttatttttagggaggtttttcaatgtttgaagaaactaaaaagggctttgactggtttagcctaattgttggagtcttatttatcattgccggaattgcatcattcacgcggccagataaaacccttcacttcttagccattgttgccggaattgcttttattttccgcggaatttatgaattatggttccgtcaacgaatcggtcgaatcttaggagaatcctcaggttggttaattttttctgcaattttagatatcattttaggaattatttttcttttccaaccaagctttggggtactcttcattgctatcatcttcgctatctggtttatccttgactctatcactgagttgatcagtgctaagtttttcaaggaattccatcgcggatactactggttcattataattctggcaattttgagcttggtcttaggagttattcttttatttagcccattactttccgctattacagtggtatggttagtttcaacattcttgattgttttcggaatcatgaaacttattcaagcattttaacatataccttatattaaaagagatcagttttgctgatctcttttaattttacgaatattttgaattataagccttgttccatcatcaaatattaagtggtgagcatggtgatcaattcgttttaattgccccgtgtattcttcataaaaaccagtcttaccattaaagaattcaacttttattagcggatgtgatcggccccgttcaatcatggcaagttggactctaattcgatgcctcatctcagctgtgggataagttttatgaccatacttttcccctacctttgctaataattgatggtagccggtcaaggccgcaaaaggagaaaactgcgcagcgcgatcttcggtggtcattggcgtatgagcttgagaaacatgccgaggggtattgatgatatcacgatactttgaggtatcactaaacaagcttttttctattttcaacaaatcttcattttccattatgcttggtgccctccaatctgattatttctttccaaaagagtagcaccttttttcaaatccgccgctcgaataatggcgtttttaccgtactcattttgcaaatcaaggacaagcctttgtagtttttgatctttttcttgaaccttggaacgactcttatgttttttcgttgagtccgtaaataaatctaactgctcattataattcgccaatcgggcaagtcgtggtgaaagaaggttgttcgctattaccgtaattttacgagctgtcaatcgccgatcaaggtcagaatcacataacttcataaatgcctccatcaattctgtcccagatgaagtcggtaaggaaagattagcttttccgtgcattggctttggcgcctggcgtccatagaagtctgtcactaatggtccttggtaatcctccgatatattagaaacatcataggcgacccttaaagctacttgatcagttactaagttttgcttggttaactggagagctaatgaattaaccatctcttgaatcactaaccgggtttctgtaaagttataaggtcgaggcaacacctgcccagaatacaccccatgatctgatgaatgataatttttgatatctttaatggtggctgactcatatccccacgcatggtcaataatgatttccgcattttttccaaattcgcggtataatacttcttcattcattggatcagataactttcccaaagaacaacgagcaatatctcccattgtatgaagacctagcttttttagtcgtcgtgcatatccagggccaattcgccaaaagtctgttagtggctgatgcgcccaaaggtaacggcggaaagtatgttcattcatctgtgcaatccggaccccgtcttcatcccctggaatccgtttagctactatatccatcgctactttcgctaagaaaagattggtcccaattcctgcagttgcagtaatctgggtctctgctttgatcgtttggatgatttccttagctaaagaacgggcactaacatgatattcattaagataatcagtaatatccatcattacctcatcaatagaataaacgtggatcttttctggtggtaaatagcgtaaataaatttcatagatggcgacacttttttcaagataaaaattcattcgtgggcgcgcgatcttataaccaattttaagttctggtgattttaatagttcatcccggtaaattgaaacaactggtgataatcgctggtgagacatttctttggcacgacgattattcaagtacgctacccgttgttccacctcatacaatcgcggacgaccagaaacgccaaacttttttaaagctggtgagacggcgagacaaatagtcttactagttcgcgattcatcggcaactacgaggttagcgtttaaaggatcgagcccacactcagtacattcgaccgaagcatagaatgattttaaatcgattgccatatatgttcgccccatcataagaatacctccatcgcttcaataaatactattatatcttcaatcaaacatatgttcaagaaacgaatgaaaaataaagggttgcagaaagtaattttccacaactctttactcagcttaatttaattattcaatatcaatatggttttcgtcgtcatccgtctcatccatcttaggaagagtaattgtcaaaacaccattcttatattgagccttgatatccttcttatttacatccggcaaacgatattgccgactcatttggccataccgacgctcagaatgcaaaacattgccatccttgtcaccatcatcatcaaaagtgtcccgatgaccagtaactgtcaaaatatcattagcataattaatgtgaatatccttcttatcaaatccaggcatgtcaatctttacggtataattcttgtcatcttctgtaacatctgtcttcatgtgatcagccaccggagttaggttagagaagaaatcatcgttcatccagttacgcatgttcatcaaactatcaaataaattattacggttttgtaattcattagccataaagaatgcttcctttctttcttattcattgtctatgttaaacgctttcagctaaaatgcaattaatatgctagggaccattgactaaaaagaatataatagaagtaggaaaattgaaaggagccgtgcaagatgaaaaaagtcacaatcaataatgtttcaatgcccgcaattggaatcggaacatggaatataggaaattccctcgtcaaccggtccacagaaattaaagcaattcaaactgcaattgacgctggcgcacaagctattgatactgcggaaatgtatggcgatggtcgttctgaagcgcttgtcgctgaggccatcaaaccatataaccgggaaaagctattcttaattgataaagttcttccttcaaatgccagcaaaacaaaacttgagcatagtttaggccaaagcttagaagccgtaggaacagactattttgacctttaccttttgcactggcggggtgggatcccgttggcagaaacagtcaatgaattagaacgagttaaaaaggcaggaaaaattaaggcatggggggtctcaaacttcgatgtcagtgatcttgaagaattatggcgcctaaaaaatggcactaattgcgtcgctaatgaggatctctataatctcgatagtcggggaattgaatttgaccttcttcccttaatgaaacaacatcagctcccattaatagcttattccccgcttgcacagggtgacagcctatctggaaagttaaccgataattcgctactaaaagaaattgccgcaaatcaccatgcaactgtcagccagattatgcttgcgtgggttttaagaattggaaatgtccttgccattccaaagagcagcagtccaaaacatgctgaagaaaatgttgcagctggtaatattgaactaagtgatgatgagttacttgctttacaaaaagaattcccatcaccaactaaaaaagagcccctcgcagtaatttaagagttgtaatgggatgtaataaagctaaaaagcaaactacaattttgcatttcacaaagttgcagttcgctttttcatatatgaggaaaactaataattaattttcttgattagcctttaccgggtgatagcgatgaagacgttgagatcctacatcaatttctgctggattacctttgtgacccggcttaatttcaacaaggcctaacttaatagcccccacaggacaaacaagtgcacaaagttgacaaccgacacacttactcttatcaaagactggttgccgtttttcatcatcccaagttaaagcttggtgggcaccatcttggcatgagataaagcaacgaccacaaccgatacacttatcccaatcgatcttaggataaaccttgtaatttcggtcaagttggttagtaggaataatattcttattagctaagccgacaagatcttgaaggtgatctacatgttgttcttccatgtaatgcattaaaccattagtaaggtcatcaatgatccgataaccatattccatgatcgcagttgtaacttgaagagtggtagcacctaaaagaataaattcagcagcatcttcccaggtctcaattcccccaatcccagaaatcggtagttgttcaaggccggctgctgaccgtaattgttgtaagaaacgtaaagcaattggcttaacagctttcccagataatccagaaacagaagatttaccatcaatatttggtaagccaactttcttctttagatcaacatcaacaattgatttaaccgtattgattgcggaaaagccatctgcccctccttctagacatgcctttacaactggaaccatcgtcgtaatatttggtgtcatcttcgcaaggactggaaggctagtcccacgtttaacagcttcacaattcttcttacataattctggattagttcccacatcagaacccatggtatgagaagtcatctgcggacaagagaagtttagttcaatcatatcagctccagtctcagttactaacttggccaggttggtccaatcttccaaggtttcacccatgattgatgcgatcaagaccttattggggtattcttcttttaaccgtcgcatatcagccaaatcttgttccaaggggtgttctgataattgttccatattcttaaaggcaacaaaatgcatgtcttccttggctaattcatcgaaccggggagaaacttcatcaatcttaaagtgtgttggtgataaagtcttatatacgataccgccccaaccagcgtcatatgcattcttacacatttcgtaacagttcccaacaggtgaggacgacaagcaaaatggattttcaaaatgaacgcctaaaaagtctacagataaatcttttttaatcattttcttgtcctcctaacaaccggtctatttcttcggctacttcttttcctttctgtactgctaccacaacggttttatctccggcaacaatatcaccagtcgcaaagactttaggatcctttgtccggaatcgtggttcacggaatggaatttcattatgctgtaagtcaatgtctagtccttctgcattcgctttttgaccaactgctaaaatgatcttatcagcagtaatagttaattcactcttaatcttccggtgagtaaaggtagcacgattctgatgaacttcttttggaacgtaaccatcaacaattgttacaccagcttcttgagcaccggcaagttcttttttagaagctttgaattcatcaaactgctcataaataacatcggtgacataagggacgttaagcttctttaaggttgttacaacatccattgcaacatccccaccaccaataacaaggacattttgcggaagatcttctaaattgcccttactttcttttgcccgggctaggaatgagattgctgattcggtacagatattgtgttcaaacattggcagcatctttgcttcacttgtcccaatagcaacaatcactgcattgtaacgagctttaagatcatccattgaaatatcttttccaacagttgtgttatagataatgtgcgcaccaaggtcgacaattcgttgaacttcataatccacaatttcttccggcaaccgatactcaggaatgccgtaggtcaagtaaccgccagccttagcagctttttcatagatatcaactgcatagcctttttcgcggagagtcgtagctgcctgtaaacctgatgggccactaccaatgatagcaatactcatcccgtttggtttaccggctttaaggatcttcatattcatctttcgttccatatcagtgacataccgttgaatcccaccgatatcaattggtccgtcgattttagcccgggtacatgccttttcacagtaacgctcagttggacaaacacgcgcacagattgatcctagcgcattgttttcccgaatcgtttcagctgcccctttgacattacgaaaaagaacgcttcgaataaatttggccggattagtatgtgctggacaggcttgtgaacatggtgcatcatgacataataaacatcgtgcagcttcctgcattacggttgtcatcgtgtaacctttcgactctgtttcatactttgaagtcattagacgccctcctctaagttgtgactctttgacaattttgtgataaacgtaactttatatataaataatattatataaacgttttcaatataagtaggcgatccccttaatatattgacctttttattcttaaagttgatattctcgtatatacaatatgaatatttttatttaacatccacaatagtttttgtatcaaaaatcacaaaaagagtcttattacttaatgaaaaatcaaattccttgtacaattattacagagacatggtttggttaaattgaaagaaggattaacatgaaatttatttcttggagtgtcaatggcctgaagtcagctattaaccatggatttgtcgaagattttaagcgccaagatgctgacttcttctgtctacaacgtacacgattggataaaggcgaagaaccgattcaaattcctaattattaccaatactggaattatgcagaaaagaagggttattctggtaccgccattttcactaaatataagccagaaaacgttatatacggaatgaataattcaatttttgataaagaagggcgactaatcacgctcgaatatccaaacttctatttgattgatgtatacgtcccagtttcaggtgaaaagctgcaacatcttgattatcgtctcgactgggatcgtgcttttcttgattatgttattaatttacaaagtagtaagccagtaatcattggcggtgatatgagcattgcctatcaaccaattgacttagcagagccaacagaaaatcatcataaagccggctttacaaaacaagaacgagctgattttggtaaattacttaatgctggcttgacggatactttccgttatctccatcctaatttgcatggtgcatatacctggtggagctatcggtatgacgcacgggaacgaaatgtaggttggcgtctcgactacttcttagtttctgatgtatggaaagaacgaattgaagaagccaagattctttcagatgttaaaggctcaagtcactgtccaattgaacttgttgcgaatgttgaattataggaaaaccaagctgaattttataatatttaaacgaaacgaggttggaaaaactaaaatttttccaacctcgttttatcgtatgtttgaaatttgttgattatctattttattaaatcttattttagtaccaaccgtgtgattgccagaatgattgagcagcactccaggaaccgtaacgactagctacgtattgatcagctactcgttcttggttagcttctgagtagtcaccatttaagtatgatgctgacaattggtacttaccaatgtattgaccattccgtgcactgtagctaccacctgattcgcgagctgcgatccaagccttggcagcagcatcatttccagctacatttgagttatagccagttgatgcttgagcactagattgttgttgtacattttgtgtttgtggagtttgtacttgttgttgagcaactggtgcttcttggtttgattgtacttgttggttttgttgtgcttgattttcagcaggtgtagcttgtgtatctgcttgtggtgcaacatttgcggctggtaaagtagcaacttcttcttgagtagctggtgcaacttcaccatcatccttgattactaattgttgaccaacgtaaatcaagttcttatcagcaatattattgttgtttgctaatgtatctacaaaagttagatcgtgacctaatttgtaagaaatcccagaaagggtgtcacctgcttgcaccgtgtaaatactgtcggcgtttgcagtcgttgcagtagctactgttcctaatgcaactgcaccagtaatcgctgctgtaatcttggctactttcttagataacttcattataaattcaatccatccttttctcttaattaatcaaataactcatttcaacgataactactatacaggattagggttacaagcgggttactaggacttatcaaatttcgttatttctgtaattttttgtaacaaacgttcgctgatttttttatagtcgcttaaacgttgatttaatcgcttttgagtaacttgtaaaattataactagaattatctcatgtaaaaattattcaaaaaaactgctcattttttcttgacgacacaaaaatcgccctgtaacggactgtttgttacagggcgatgacaaaattgtcttaatcgtaatcttaattattcatcaaaacatcaagcaattcttgagctgattctttcaaagcatcctttgacttgtcattaccaaggtgagtaaagatttctccaacgtatacatcttggtcaaatagctttgtaaagaccttgtcaataatcggcttagttaattctggttcttgaactgggccaaatgggttagcaaagaatgtcttgctcattccaacttcatcagttgttccaagggccttccgttgtccagcaataaatactttttctgcctcttcctttgtatcaaaacgatgaataccaacttcatcactgtaattgttagcgtatagccacatatcaatatggtgatgtttgattacgttttcgtaggtatcagcaggaataataacccgggcattcttttgttcaggattaaggtaaacaccacggtccatgttattgaaggccacggcactacttaaatcatcaagacgaacaaaggcaccagtttctgttccttgagcatatacccctggttcaccatcagtaagggtaaagcttcccatgtcatcaaagattgtctccatgctgacaatcttatcgtcagctaattcttgcaatgcttcaattgattctgactttccggcacctgaatcaccgaagaaaacaacattcttttctttaccattagtaaatttaatcttcaacatggacccgtgaattggcaggcgaccattgtaaatttgatgaaggttatggagcgtcaagcacatcttcttcatgtaaccaaagtaagtagtcttatctgcgtaaggtacttcaccaacccacaaatcattcttttcgtcacgatagtaatgagaaaccatgccttctgtttcttttagaccgaaaagaaggatcatatcaggtttttgccccttaatctcatcaggggatgcaatttcaaataagtttgaaagcgcgattccgtttaccaagtaatcaacattgaagtaaataaaggctaaactttcaccaatctttgctgggtaacaataccacttaccacgttcaccacggaaacgttcgatcgggttatcttttacttcagaaaagaccccttcccgtttgttactcttagtgtgcatcatcattggtggacgaagcatcacggtattaataaaatcaatatcctttaattcttcataaccagctggaattttccaatcttgttgttgaactaagattgttgcgttagttgccgcattaacttgtcgataagtccggttttcaaaaccttggagcttttcttcgaggatccggtatgctttacgcactaagtcgttgaattgagtatcaatagtccggaactcgttaccgataatcttattatcactaagattaattaccgatacccgtaatagtgaacgatagtatgagtataatttttcaacactctcaagaatatctttagggtcatattcatcaaatgcactatcatcatcaaaaagaactttctttaagatatcaacaaacttgttaacagtggcattatcaaaagcatcatcatcattatcagggttacgtgaagctaaatataaacggacaatttcctttacttcatcactattaattaatgaaggaatatcagtaaagtaattttgactatagtttaacgttgcaacaccgcggtcaggatttacatataatgattttgtatcaataatctgactctcttttgacatggatctcatcctttcatcacttgaataactctattataatatattttttaagattaggatgaaaataatattaactttttttcattttacaaaaaaataggaaattatccctttattgagacaatttcctactttaacaattaattattaaattttagtaccaaccatgtgattgccagaatgattgagcagcactccatgaaccgtaacggttagctacgtattgatcagctactcgttcttggttagcttctgagtagtcaccatttaagtatgatgctgataattggtacttaccaacgtattgaccgttacgagcactgtagctaccgcctgattcgcgagctgcgatccaagccttagcagcagcatcattaccactaacatttgagctgtagtttgaactagtagcttgtgcttgtactggtgcactgtagctttgttgtgcagcagctgaaacagttgattgttgtggagctactgattgaactggtgcttgttgttgaaccggtgcttgagattgtacttggcttgttgctacaggagcctgactagcaaccaccggagcttggctaggttgttgactttcaacactagctgatgctggaacttgagatgcttcaggtaaagtagcagcttgttgagcagttgcttgagttacctcaccgtcatctttaattactaacttttgaccaacataaattaagttcttattggcaatttgattagttgaagctaaagagtcaacataagttaagtcatggcctaacttataggaaatacttgataaggtatcaccactttgcaccgtgtaaacagaatcagcattagcagtagttgcagtagcgaatgttcccaaggcaacagcacctgcaacggcagcagtgattttcgcgatgtttttagttaacttcataaagaaaaatcccatccttttcataaaatacttttttattaattagttatttattagtttaatttagtttaagttgttgagtcctcatatctctcaacacctattactatactccctcaaaattacatgcggattactccgaaatatcaattcagttgtttttcgtaatactttgtaataaaaattttaatagtctgtcaagcaaatcaacctcggccacgtcctgatagtaacttaggtttggttaactttttcccagaattagccaaaatttgtaacataataataaataagtcgctgaatttttcttataaagaagaatttcaacgacctatttttcgttattaatgttttattgtaacattgctgtaattaactttagccctattcaacagtcattatttgttttagccaacgctcactactagctaattcttttaatggatggatatcttcgttaattggcagtcgttcgccggcttttactttaaaaggtgcgccagtgaccatttctaaatcccgatattgggtaagagtggcagaagttcccttaccaaaaccatcaaccattgcggttaaccgctgcgttccacttaatgcaattgtgggggcccactgagtattttgaccatccagaaaactataaagatcaacagtagctttagtttgaacttgactcgctacttcaaactgcagcgttgaaccatgggcttggtatgcatggattgcccgatagatatttttactagttgagcggtttgcctgccggtacgtaacatgcgcgttagctccgactaaaatctccgtcccttcatatgatggtaataacgtatcattaaccatccgttcttcaattactgcgttagcccccgcgctgatgacaataatattgtgagtgttcgcagagttaaggtggggactaaagacaactggacgctcctgagtaatttgtggacgcaaatatataaactgtccacaatcaatatttgcaaggtgcatggccgctaactggctatcctgccaaaagatggccttctccattaaattttcttgtaatagtgttgagtattcattaaccgcttgttcaagaggcatcgctgttaggctgtcttcctgtaaagaaagccaacccctacttacaccagttgttctcttttgccagtgatctacccattcttcttgaccaggtaaagtcgagaaccgtgattgcagcagaactgctagttgacgttttttctctaaccatgctggctctttcttccaaatttttgccatcattttctcctctaatgaacaagcttatcccaaataaccactttccccgtttgaagagattgcggaacatcaataattcgttggttagaactccctctaaactgaagggtaagatcctttttagccagcaagaatcgaccatcgactagaatatcgaggtagtgtagaagttcaagtttatcgctcgactccttcattaattcttcccaagtatagccagaccaagaccaaatatccttttcgtgaccgaattctttacgaacccgtttaactaacttcagacaaacctgagtattaaggaatggttcgccacccaataaagtcaatccttgaacataactctgcgaaaggtcttcgataatctggtcttctaaatcctgggtatatggctgtccataatgaaaattctgcgccgccttgttatagcatccggggcagttaaaaaggcatccactaacatataaactacaccggaccccttccccgtcaacaaaattgaagggcttatagtctgcaatatattgtaatgaatgatcttttgctaaccactcttgcggcttaggattgcggggtaatcgtgtttctgccatttctttttcctcctatataataaaaggccggtagctttgtgggcgactggccttttgataattaattaaatttgatcaccagtaatatgagcatgggctttattatccatttgccgctgctgctcaaattcagctgcattcttgatcatgccagcattcatatgtttaacccggtgaataatttcctcatgccgtccatgaaccattggccgctgctgaggattaccaagataaccacatgtccgcttaacaacatcacaagttgctgggtcatggtttccacactgcggacacttaaaaccgcgagcagttgcttcaaattcacctttgaatccgcacttaaaacactgatcaattgaagtattcgttccaagatagccaacatgatcatatgcccagtcccacactgcttctaaggcttttggattttggcgtaagttaggatattcgcaataatgaataaaaccaccagccgcgtacttaggaaaagcctcttcaaatgataacttttcaaatggtgtcggatgtttacgaacatcatagtggaaactatttgtgtagtattccttatccgttacatcttcaacccgaccaaacttcttcaaatcatcttggcagaatgtatctgttaacgattcagcaggagtggaatagagactaaaatggtatccttcttctttttcccattcagcacataaatcatgcattgccttagtaattgcaatcgcaaagtcatgcgcttctttattatgctcccaatttgacccatagaaagtcgtacatacttcatataaaccaatataacctagtgaaacggtcgcccgactattcttaaagacttcatcgacactatcagtcttctttagccgtttgccaaatgctccatacatatacaggaggggagcattttcaggtttagcttctttagtacgcttaatccggtaatccaaggcaatcttgcaaatattcatcttctcttgaaagatttcccagaatagttgcttatcgccatgagcctccagggcaatccgtggcaagttgactgtcactactcctaaattcatccggcctgagtttacttctttaccagtttctggatctgtccatccctgtaagaacgaacggcaacccattggtgtcttaaagctccccgttagttccttaatcttgtcatacatcaaaagatctggatacatccgctttgttgaacattcaagcgctagttgcttgatatcataattaggatcttcagggtcaagatttaagccccgtttaatagtaaaagttaatttaggaaaaatggctgtacgatgttccttcccaaggcccttaatccggatcttcaaaatggctttttggatctcccgggcaatccaacttgtccctaaaccaaagttaatggtcgtaaatggagtttgaccttggctagaataaagggtattaatctcgtattctaaagcctgcattgcatcgtaaatatccttttttgtcttctcacgagcaaattcttctcgtttctctggtactatccactcttcagcatccttcatatgcttttcgtaatttagctttgcatatggttctaataattgatcaatccgattagcagaacatcccccatattgcagagacgccacgttagcaataatctgcgacatctgtgcggttgccgtttgaatcgaacgtggtgaagaaacccaagcattaccaatcttaaatccatgcttaaacatctcatcaaagtcaattaaacaacagttagtttcaggcgttaccggtgaataatcaaggtcatgccagtgaatatcaccacgaagatgcgccttggccacaatacctggaagcatccgtaatcctaatgcacgactcacgacccctgcttcaaggtcccgttgagtattaaaaacatggctatctttattagcattttcgtgaacaatccgggagtttcggtcgaaaagctgctctaacttattttggggattagtggcttcagcaaatgcttcttcatcatgctggcgataatcacggtaaacttttgccaattcttcatgattagcattgaccagtccttgaacaaagagatccgcaatctttttagtagtcacagttgtttgattaagcaatgcatccaataaggtaacataaacactttggctagtctgctcatcagcattgagcgcatttaaaacaagattaatcttataggaatagaatggtgttactgttccatcacgtttaactacttgaacacttgttaaactttgaagatccttcttatcaattatttgcactttcatttttatttcccctctcgtaattaacgttatctatcatagctcaaaatacaacttataggaagtattgacattcgaaacactatatgttgtggtcaaattactcatttaaatattctgtttatattctattctgatctaccaggaataaaatgaggatacaagcaacgacgctattttgagattattgctagaccttttaaatcatttatttttaaattcctattatcactgaatagaattttctatcccgaaaagcgcaaatttgaaagcgctaaacctaacttaataatcttaatcaatatacttaagattattagttattaaaaaaataacttacgagcagatagcacgatttgctagactaatctttgtgcaatttttagggtaaaaggagtttttatatttatggaaaatgctttacaagctcgtaagcaagcagcgcacccagaattaatgatggttagtatgctgctgggagcttttgtcggaatgtttagtgagacttcattaaatattgcgttgccaaaattgatggctgcttttcaagtaagtacgtcaacaattcaatggttagttactggatatatgttaattattgggattatcttgccactgtccagtattattactaaatggtttacgacccgccaagtcattatttttgcattaattgacttcatggttggggcttgtatttctgccttagcgcataattttacaattttgttgattggacgaatgattcaagggatcggaacaggtttaattcttccattaatgtttgcagtggtaatgcaaatcttcccaccgaaacaaattggagcggttctaggaatgtgtgccctcgtaattatgtttgcccctgcaatcggtcctactttaaccgggctaattcttgctaagttatcatggcaatggatcttctggttatttattccgtttttatttattgccttgatttttgctatcacttcattagaaaatgttggtgaaattactaagccgcatgttgatgtgctctcaattattgaatcggcagtaggttgttcagggctcgttattggtgctagtttggctagtgaagatggttggacttcacctacagttctcagtgcgttaataatcggaattattgtcttaatcttttacacccatcgccaacttcatctggaagaaccaattttaaatcttcatatctttaagtatccggccttcacaattggttcttcaatcgtgatgcttgactttggaattattctttctacgatgtatcttttaccgttattctatcaacgagggctcttagtttccgttgcccttactggactagtaatgctccctggtggaattattaatgcagccacttctgcaattgcaggtcgcctttacgatagtatcggggctaaacgtcctgttttaattggttttgtccttgccttattcggtgctttgatgctggcatttacgacaccacatagtcccattatctacgttgtatgcgcgcatgttattttaatgattggttgtcctttagcaatgtctcctgcacaaactagtgctctaagtacgctttcgggattcgaatccggagacggcagtacaatcatgaatacgatgcaacaggttatcggtgcgcttgcaacagccctagctactagttgcttagcttggggtagttcttctattagtggatctgaagctattcgctttaccaatggtttccactacggcatttactttgcaattatcttaattgtggtagcactgctcttatcattcaaaattaaagatcagaaaaactaaataaatcctcactactcatgcaggtagtggggattttttactctttaacaatcttatacggcaagtaatggcggcgatgattagtcagataactatccattaactgttggtaaagctgtggattcacgtttgattgtgtacttaagagatcaaatttttcattatccttttcaacggtataaagacccgttttgacaaaaccatttttagcgtaaaaacgatgtcgtctgagtcgctgttcgttattgggtgcttgagggtctggacgttcagcgctaagggtaatccgcttttcagcataccgttctttaatcgcggttaacgtcgcactacccaagccctgtccatgatagtgaggatcaattgccagaaagaaaatataggcgatgcgcttgttgtagactgtgtagaaaaagccaacccatttcccctcttcattatagatgctacaaaattctgctttccccgctttagcacgcattttaagtaaagataatggtaaaagttcattttgtggaaacacagtattataaacccgcttgatatttttgaaatcatttgaatttgtagatatttgacgaactttaatcatttaaaaatccctccatctatgtaatagtacctagaaaaaacttaccagacaagaaaaaagagactagctttaattttaattaagcttcaatgaaatcttgctctttcgcatgtatgtttttacagcaaaacatgcctcttaaaattacgtggcctatttttgaaaactggggtgataatttcattttgttctgccataaattaaaaatctccttactgatgatagtctcagtatagaagatttggggtacttagaactaaacggattgttattgagtacttacggatgcacaaatgatgcacaaattcaattgaaaataaaaaatatttaaaacataaaaactcctataacccttgatacacaagagttacaggagttaacgttagcttagctgatacttcgcattcctacttaaatatgcctccggtgggggtcgaacccacactccctcaacgggaactggattttgagtccagcgcgtctgccaattccgccacagaggcatcagctaactaaaaggtggtaatcggatttgaaccgatgataaaggttttgcagacctctgccttaccacttggctataccaccaaatagttaagattaagtaataagcttaatcaaaagggcggtatgtgggattcgaacccacgcgtgccggacccacaaaccggtgtgttaaccaaacttcaccaataccgccaaaatattcagttaagcagggatagtaggaatcgaacccacaatgacggttttggagaccgtagttataccgtttaactatatccctataaaatgggggagagtggattcgaaccaccgaacccgaaggaacggttttacagaccgtcgcgtttagccagacttcgctactcccccataaatggcgcgggacggaatcgaaccgccgacacacggagcttcaatccgttgctctaccaactgagctaccgagccatcgtgtcatgggtatatacaactattaagttgtaatggaggatacagggctcgaacctgtgaccccctgcttgtaaggcagatgctctcccaactgagctaatcctccaaaagtgacccgtgcgggatttgaacccacgataccagcgtgaaaggctggtgtcttaaccacttgactaacgggtcataacaacggagagtaagggattcgaacccttgatacaggctttaacccgtatacatcatttccaatgatgctccttcggccagctcggacaactctccaatatccaagccctggcacaattaagaccaggtgccaaagcttgattttgcgtggcaacgtcctatcctcgcagggagcgatcccccaactactttcggcgtgttgaagcttaacttctgtgttcggcatgggaacaggtgtatccttcaagccatcatcaccacactctttgtcccttcggacgagagcttgtgctctcaaaactaaatcctatctattctcttccaataaaccttaccgctccttggttaagtcctcgaccgattagtaatggtccgctccatgcctcacggcacttccacttccatcctatctacctcatcatctctgaggggtcttactttcccgaaggaaatgggaaatctcatctcgaggcgagtttcacacttagatgctttcagcgtttatctcgtccatacatagctacccagcggtgctcctggcggaacaactggtacaccagcggtatgtccatcccggtcctctcgtactaaggacaggtcctctcaaatttcctacgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccagggtagcttttatccgttgagcgatggcccttccatacggaaccaccggatcactaagcccgactttcgtccctgctcgacctgtctgtctcgcagtcaagctcgcttgtgcctttacactctgcgcatgatttccaaccatactgagcgaacctttgggcgcctccgttaccttttaggaggcgaccgccccagtcaaactgcccacctgacactgtctcccagcacgttcagtgctgcgggttagagtggtcatattgcaagggtagtatcccaccagcgcctctgtcgaaactagcgtcccgacttctacggctcctacctatcctgtacaagcagtacaaacactcaatatcaagctacagtaaagctccatggggtctttccgtcctgtcgcgggtaccctgtatcttcacagggatttcaatttcaccgagtctctcgttgagacagcgcccagatcgttacgcctttcgtgcgggtcggaacttacccgacaaggaatttcgctaccttaggaccgttatagttacggccgccgtttactggggcttcaattctgagcttcgccgaagctaacccatccttttaaccttccagcaccgggcaggcgtcagcccctatacttcatcttacgattttgcagaaacctgtgtttttgataaacagtcgcctgggcctattcactgcggctggccttgcggccagcaccccttctcccgaagttacggggtcattttgccgagttccttaacgagagttctctcgctcaccttaggattctctcctcgactacctgtgtcggtttgcggtacgggcagttaactactccttagaagcttttctcggcagtgtgacatcggcaacttcgctactttaatttcgctccccatcacagcttgtcaacacggatgtaaacatttgactcacatcctgacttactgcttggccgtactcttccagtcgtacggtttgcttagcctcctgcgtccctccatcgtcaaacgcagttaactggtacaggaatctcaacctgttatccatcgcctacgcctctcggcctcggcttaggtcccgacttaccctgggaggacgagccttccccaggaaaccttagtcattcggtggacaggattctcacctgtctttcgctactcataccggcattctcacttctaagcgctccaccagtcctcacggtctgacttcgccgcccttagaacgctctcctatcacgtgcacatagtgcacatccacagtttcggtaatatgcttagccccggtacattttcggcgcaggatcactcgactagtgagctattacgcactctttaaatggtggctgcttctaagccaacatcctagttgtctatgcaactccacatccttttccacttagcatatatttagggaccttaactggtgatctgggctgttcccctttcgacggtggatcttatcactcatcgtctgactcctgagtataaatcgatggcattcggagtttatctgaagttggtaacccatgacgggccccttgtccaaacagtagctctacctccacgattctttacctcaaggctccccctaaagagatttcggagagaaccagctatctccaagttcgtttggaatttcaccgctacccacacctcatcccagccattttcaactgacacgggttcggtcctccagtgcgctttaccgcaccttcaacctggacatgggtaggtcacctggtttcgggtctacaactacatactttttacgcccatttaagactcgctttcgctacggctccggtttttccaccttaaccttgcatgcaatcgtaactcgccggttcattctgcaagaggcacgccgtcacccattaacgggctccgacagcttgtaggcacatggtttcaggaactatttcactccccttccggggtgcttttcacctttccctcacggtactggttcactatcggtcactagggagtatttagccttgcgagatggtcctcgcgggttccgacggggtttcacgtgtcccgccgtactcaggatcctgaacagagagtgtgacgtttcgtctacggggctttcaccctctatggcacagcttcccaactgttgcgactacgtcgcactttggtaactctaatgttcagtcctacaaccccaacaagcaagcttgttggtttgggctcttcccttttcgctcgccgctactcagggaatcgatgtttctttctcttcctgcagctactaagatgtttcagttcactgcgtctacctcttgctagctatgtattcactagtcaagtaatcagcgactaagctgattgggttgccccattcggaaatctccggatcaaagcgtacttaccgctccccgaagcatatcggtgttagtcccgtccttcatcggctcctagtaccaaggcattcaccatgcgcccttcataacttaacctaaacaatcaaagattgtctgattaattgagttagcgattataattcgttaattaaaactcaaataacgcggtgttctcggtttattgttttgttaataaagaaatcagatagtatttagttttcaaagtacaagctctgagggtaaacccctcaaaactaaacaaagtttcttcgatgtgtaggttccgttttattccttagaaaggaggtgatccagccgcaggttctcctacggctaccttgttacgacttcaccccagtcatctgtcccgccttaggcggctccctccataaaggttaggccaccgactttgggcgttacaaactcccatggtgtgacgggcggtgtgtacaaggcccgggaacgtattcaccgcggcatgctgatccgcgattactagcgattccgacttcgtgtaggcgagttgcagcctacagtccgaactgagaacggctttaagagattagcttactctcgcgagtttgcgactcgttgtaccgtccattgtagcacgtgtgtagcccaggtcataaggggcatgatgatctgacgtcgtccccaccttcctccggtttgtcaccggcagtctcactagagtgcccaactcaatgctggcaactagtaacaagggttgcgctcgttgcgggacttaacccaacatctcacgacacgagctgacgacgaccatgcaccacctgtcattgcgtccctgaagggaacgccttatctctaaggttagcgcaagatgtcaagacctggtaaggttcttcgcgtagcttcgaattaaaccacatgctccaccgcttgtgcgggcccccgtcaattcctttgagtttcaaccttgcggtcgtactccccaggcggagtgcttaatgcgttagctccggcactgaagggcggaaaccctccaacacctagcactcatcgtttacggcatggactaccagggtatctaatcctgttcgctacccatgctttcgagcctcagcgtcagttgcagaccagacagccgccttcgccactggtgttcttccatatatctacgcattccaccgctacacatggagttccactgtcctcttctgcactcaagtcgcccggtttccgatgcacttcttcggttaagccgaaggctttcacatcagacctaagcaaccgcctgcgctcgctttacgcccaataaatccggataacgcttgccacctacgtattaccgcggctgctggcacgtagttagccgtgactttctggttggataccgtcactgcgtgaacagttactctcacgcacgttcttctccaacaacagagctttacgagccgaaacccttcttcactcacgcggtgttgctccatcaggcttgcgcccattgtggaagattccctactgctgcctcccgtaggagtatggaccgtgtctcagttccattgtggccgatcagtctctcaactcggctatgcatcatcgccttggtaagccattaccttaccaactagctaatgcaccgcaggtccatcccagagtgatagccaaagccatctttcaaacaaaagccatgtggcttttgttgttatgcggtattagcatctgtttccaaatgttatcccccgctccggggcaggttacctacgtgttactcacccgtccgccactcactggtgatccatcgtcaatcaggtgcaagcaccatcaatcagttgggccagtgcgtacgacttgcatgtattaggcacaccgccggcgttcatcctgagccaggatcaaactctcatatgaaatatataagaacttgaatagctctcaattatctttgttattaagcgaattgacttcgcaaatgttttgcttcaaatcacatcgtgattgaagaccctacacatttgattcgtcgaaactttgttcagttttcaaaggtctacctgttggccaatcaagtagccgatcaacgtattcattatagcatacattagattagcttgtcaagaagaaattttaattaactttgaatttcttttgattgataactcaatcagcaactttattaatatatcatatcgtcaattagatgtcaacaattattcttaacttttttgtcaaaccatctcagcagcacttaactgctttgacaacgataactactatacatgggttttgattccccgtcaactgttttttctaaaaaaattaaaaagtattctcaagatcatataaacagttaaaaacttcaatagcaactaggtcaatatcatcaaaacgaaaacgttcataaggtcgatatcgaacaaagataaattcttctctactatgaatataagttacatcgcataatggaataccaaattttttaaatgtccgtttctgtcgatctcttgaatcattgttttgcatggcaatcaaacgtctaataatcactaataattctgattccttcacaaggataatcctccttcatacaaataaaggatcgtgtcttcacacaatcccttttttctatcttttaactttatccggccttataaatacagctacaattccggcgaacattccaaagtaatatgtaagtagtcgccataagatcattgctaaaaccaattttgtatttgagtgaataaaacttgcaaagagaacggaaaaactatactcggctccccccgcccctcctggaattggaaaaagcgaaataatcataaaaattaaaacgtgcaagctgagcaccatcacaaaattaatatggttaattccaagtgcaagcataataaagtatgggattgcatagtaaaagaataattgaaaaatagttactacgcaaaccttaagcagcttcttataatctcgcttcattcggagactctcttggtaaaaagtatccactttttcatttaagacgactttcatatgctcatatcggttagccttcataaaaatggcagctggtttgataacgaggttcattagtttcttagtaaaactataccagtacatcaccattagcaatccgacaattaccgctaagtgaatcaaaaagccaaatattactagtaatgaaagagcatggagtttttccgcaataaaatgaaagccaattaacaaactaatcaaaaagttaacaacaatcattgcctggaatacaacaaacttcattaaaagaactgaacttgctaatcccccatcaacacctgattgaatcattgcaactaattgcgctggctgtccccctgttgagaatggagtaatgccattaaatagttgttcaattaatggtaatcgtaatgcatccttccaggtaaagccatcgtgacgatcattcataaatatctttacgacaactgcttctaagcctaaatataaacaaatacagccaagtgcaacgagcatccatccccaattaatggcagaaacatcctgtaacaataggtggatgtttgagttacgtaatgagtagccgagaattccaattccaataattagcattatgcttaatactaaccaatttcgtctgctcactaagcatccccctttcgcgcttgttcctgataaaacttagtccaaacatctgccaaatgttcttttgagtattccttagcagctcgttgggcctgattttgccaatgtgccagtcgtgcaggatcattgcgtaataatgtcaacttcatttgcatctcattgacatctttagcaggttcataatccccttcaataatagaatgataaaggtcaagatcgcgcaacattactggtgtcccgcagctaaaagcttccaagacagacattggaaatagttcattatatgaaggtaaaagaaataggtcagcaagattgttcagttcagcaatcttatcccgcgaaacgattcctgtaaaatgtaaattagctggtggattatctactaccttttttaattcactatagccatcagttaaacgaccaaaagagaatccgccagcccaaaaaaactcaacgtccggattttggcgagcaagacggataaagtcgggaaccccttttcgttcttgaacctggccgcttcctaataccacaaatttatcggcagcaatcccatatttttttcggagagcagtccgcttaacagccgaatatggatggaaacgatcattatcaacaaagttaggaatataggcaatctttttttcaggaatcccgtatgctactaactgcttgataaaagatggatttacaactactaactgatccattcgtttataaaaggcaataatataatgataaaaaagcccgcgaaacggttgcgggattgtaagacttccttctagcgtctcaggaagaaaatgcacatagccaatctttcggccccgtttttttgaaaaagttgacaagtaaaaaagcgggtcgattgtatgataatgactgatctgactcttcccataacggttgatttcaatttcaaatttgtcactgcattggttgcgcaacaagttaattaattcaaggtaggcgcttcctactccttgtcccgcaaccttatctgcagatgaaaacattgttattttaatcatcattagctccttgggcggtgaaaaagacgatgtgatttttcagcttgattaagttcatcatggacggccatatcgttttgacaatcttggtagaactgaacaaccttttcaacaaagacttctgctgagatttcatgtagcttttgttgccgtctcaaccttgattctgagttttttggttggttaaggtaaaacaagacgcccttaaccaagtcggcccgcttttgaaagctaatgccaatcgctgggtcatcaatcaattggtcagtatattcactacgcataaccacaattggcaaatccgaggcaagggcttcatcataagtcagtccttgtgattcagaatccgaggctgaaacaaaaacatctgccatctggtaataatggtaaacttcatcatttgaaatctcaccagcaaaattaatattgtcattaagctgcatttcacgaacttgacgctccagagtatgtcttgcgggaccatccccaacaatcagcaactgtgcatcaggcttgtgagcaagaatatctggcattgcttctattaatgaatggatattcttttcatacgctaaacgactaagcgaaagtaaaactggggtctcttcacgatagcctaactttgcccttaaattagctatttcttctgctgaatcgcgtttactatatacccgtaaattaatcccagtcggaataacacgaattggtgattcaacatgataactggttaaagtatccaaaacacggtcacttggagcaataatcccagaaatattttttaaataaagatgagcaagccgggcaacatcatttggcttaagaatatggccattcgcaatatagtggagataatcttgatacatcgtatggtaagtatggagacagggaatatgcaaatgcttggcaaccgtcttccccataactccaagtgcaaattcagtttgattatgaactatatctaattggaactttttagcaagcttgatagcccgaaatacgccgcgcaccgcaatgcgacgatcagaaaacgaaacaaagggaatgcttgcaaagcggtatatcccattttcaacgtcatcatgtttcgccttaggatcagttgtcgtaaaaatatatacatgatgtccctgagcaatcaattcatcacgaagcgtcttaatcgaagtcgccacgccactcacctgagggaaatatgtatctgtaaaaataccaatattcaacctaactgctcctttttcatcataagttttctagataataattagtcataactgctattatactaaagcattcactgaaccgcaaaacagatttaggttattttaaatcttccttctaatagtgacaagactcagaaaggctgattaaaatttctttacaaaatcttttaataatgagaataaaaaataactctcttgacggtgcgaactatcaagaaagttattttcatttattaaagttttacctgcggaacatacttttccactaatttttggaccgccgcggcagtttcagcatgaatcgctcgatgaactaatggttgtaatttgcgcgtattcaactggttaattaaagagcgaacacgtaaaatctgactactgctcattgaaaattcatcaagccccattgccattaatagaggaaccgcataaggattattagccatctctccacacattccgacccacttgccttcagcatgcgcagcttcaatcacttgccgcaccatccgtaaaactgccgggtgaagttcttgatataggtatgctacttgctgatttccgcgatcaacagcaaataggtactgaataaggtcattactgccaatgctaaaaaagtcaacatacttcgcaaaatgttcagccataaccgcaactgctggaatctctagcatcatgccaacttcaatatttttagcaacttgaatacctgcttgctcaagcttttctttttcatcgtcaagaattgctcgcgccgcttggaactcttcaattgttgcaatcatcggaaacataatggctaaccgtccataaacggatgcacgaaggagggcgcgcaattgaggacgtaatatttccgggcgtgccaatccaatcctgatggcacgaaaacctaggtaaggattgtcctcatgaggaagagcaaccatccccagctttttatcgccgccaatgtcaagcgttcgggcgactacccgctgttcattcatcgccgaaacaaatcttttgtaagcattaaattgttgctcttctgttggcaattcatccttgctcatatagagaaattctgttcttaaaaggccaatcccctcggcgccatcttcttgagcatcaataacgtcagcaaatgttccgacattagctcccacttcaaagcggcgcccatcagcactcacggtttgcttatcttttaacgctccccacttttgctgctcctggataaatttaccagctaacaaacgataatgctcaatctcttcattcgttggattgacaatcactttgccatgaatcccgtcaacaatcagcaagtcgccatcgtgaataatcgtagtagcattcttgacgccgacgacagcaggcaaggaaagggtcttactcataatcgtaaaatgagaggtccgccccccattagttgtaacaatccctgcaacatatcgtttatcaaattgagcggtatcagtaggcgtaatattattagccacaaagattgcccggtggtctaaaagccctgggtctggtagggaaacattcaataggtgactcaagactcgtttggtcacatcacgtaaggcagttgcccgcgcatataaatactcattatcgttcttgcgctcaaaaacacttaaataataatcttcaacgcgtttaacagcccactccgcagtatcatgatggctattaatacggtcaataatcttcttttgtaaagtcggatcgtctaaaatcgcaatctgggtatcaataatcgtcactgcccgctggcctagcaactcatgggcatgcttagataaatgctgaagttcggtcttgcttaacgcaaaagaatcatgaagccgggcgacctcatgattctcatcagctgtatgctgtttttttatagatagatctgactctactaacaggtgtgccggagcaatcgtaataccactactagcggcaagtccggttagtagtatagacattagtcagtcaatccttccttcttcatagtttcagcaacggtgtccaaagcttctttttcgtcgtcaccattagcagtaatagtaaccttagcgttttgaccaacaccaagggacattacacccatgattgacttcaagtttacactcttaccttcgtatgaaagagtaatgtcagatgaaaactttgaagcagcttgtaccaaaatagtagctggacgagcatgaataccagtttcagaagtaattgtaaattcacgtttttccatattaatcagtctccttcgagcagatataattaatttattatcagtagctttaccactgatacacctcgataattacattttagcaattgtaagcgttaaatacaaggctacatcttgcgatttatcgctctcttaattgataaataactttaccgcctcgttgcgcttcgccttcaatttgcgaacgatatgcatacgagtgaaaaatcggttgaaattgctgaaaattctcaggggtaattacaaaatgatcaatctttttatttcgcaagtcatccaacaattgctcaaaattttcttctgccattcaatcacctcaacataaaattttattttcttattatacacgaaattactttcatctttctattttagcattcatggctaaagagtgctaaaatcaaagtaagctgttttcggcattcctaagtaacttagctacgcggaaaatcgctctttatttaagaaaatatttaagttttatagcttgctttgcgataaaaagtaagtataatattaatcaatggtcaagaaaggtcaaaacatttcttgatgaaattatttaggaggtattaaattcagatgcaatgtcaatactgtcatcaaaatccagccacaattcatcttcaaatgaattttaatgggcaacggattcaaatagacctctgccaaaattgttatcaaaaattacaaaatctacaaacagatatgatgaatggaggtaacggaatgaataatttcggttttggaagcctcgaagacttcatgaacgcaatgaacaatatgcaaagtcaagctgccggtactaatggtcaaaacatgaacggccaatcccaacgacaaggtggcggacgaaatggaaaaggaatccttggtcaatatgggatcaaccttactgatctcgctcgccaaggtaaaattgacccagtcatcgggcgcgacaatgaaattaaacgagttattgaaattttaaaccgtcgaaccaagaataacccagtcttgattggtgaagctggagttggtaagaccgcggttgttgaaggtttagctcaagcaatcgttagcggccaagttcccgaaaagcttgctaacaaggaaatcatccggctcgatgttgtttccttagttcaaggtacgggaattcggggccaatttgaaaagcggatgcaacaattaatggaagaagttcgtaagaataagaacatcatcctctttattgacgaaatccatgaaatcatgggtgcgggaaatgctgaaggcggaatggacgctggaaatgttcttaaacccgcccttgcccgcggtgacttccaattagttggtgccactactcttaatgagtaccggaagatcgaaaaggatgctgctcttgcacggcgattccaaccagttgaagttgatgaaccatccgttgaagaaacaatccgcatcttaaacgggatcaaaagtcgttatcaagattaccaccacgttaagtacacagatgacgcaattgtagcagctgctaaactttctgaccgctacattcaagatcgttacttgcctgacaaagctatcgacttacttgatgaagcgggatcaaagaagaacttaacgcttaaaaatgtggatccaaatgcaatcgaaaatgaaatccacacagctgaagcacacaagcaacaagcagctgataaccaagactatgaaaaggcagctttctaccgcgatcaagttgctaagcttgaaaaggcaaagaaggaagccgaagaaaaccatactgaagattctgcaactgttaccgttaaggatatgcagagaatcgttgaagaacggacaaatattccagttggtgacctgcaaaagcaagaagaaaatcaacttcgcgaccttgataagaagcttgatgaacatgttattggccaagcccaagcagtggataaggttgctcgtgccattcgtcgtaaccggatcggtttgaacaagtctggtcggccaattggtagtttcctctttgttggtcctacgggggttggtaagactgaaaccgctaagcaacttgccctccaattgtttggttctaaagatgctatgattcggttcgatatgtctgaatacatggacaagacctctacttctaaattaatcggggctgctcctggttatgttggttacgaagaagctggtcagttgactgaacaagtacggcggcacccttatagcttgatcttacttgatgaagttgaaaaggcgcacccagatgttatgcacatgttcttacaaattctggatgatggtcgtttaactgattctcaagggcgcactgttagcttcaaggatacaatcattatcatgacatctaatgccggaactggtgattcagaagcaagcgttggttttggtgctgagtctaatggtagtactcattccatcattgacaagttgacaaactacttcaagccagaattcttaaaccggtttgatgacattgttcaattcaatgccctctccaaggatgacttgatgaagatcgttaacttaatgattgatgatgttaataacatgcttgctgataagaacttgcatatcgaagtcattaacaatgttgaagaaaaattagttgacatgggatttgatccaaagatgggtgctcgtcctcttcgtcgggtaatccaagaacaaatcgaagaccggattgctgattacgttcttgatcacagtgacgctcataaattagttgctaaacttgatgataatggtgacattgttgtcgaagaaactgaagaagtaccaacaattgctaaaaaataactgagtaaaaaaacgaggctgaatttttcaacctcgtttttttattacgctcaatttacttccaaacgacggcggacttccaataccggaagagcaaccatcgggacaataataattgccaatatcaattctgcgagcccattagtcgccatgactgtttctaaagcaattaataaatgattaacatttaccccataagtttgcgcaactgctggagtacgataaaatagataaataaagcctaataccaagccagtattagtaagggttcctactattgcagcacttaccgcggcgatatattttgctttgaccaaacgacacataagaataaaagtatatcctgctaaaatcccaatcataatgcgcgggacaacggaaacaagcgggttaacaaaaactaagggagccagcggactacttggtgccacaaatgctcgcacccaagtcaggagcccccaaataccaccaataattgcgccatcaacgggacccaacacaattgccgcaataatgactgttacatgaagggtcgtaatactaagcggtcctagcggaatgttaccaaaaaatgggacaaaatcttgtaagagaataattgcgataaagattgctaatgtcgtattgtgcctaatttgttggtgccgagtttttgccatttttcttctcctaaataaatttgaataggcttattgtaataaaaaaatcacctattcgcaattctcaagagaaatatggtcgttccttatcgtgtcagctactaaaaagcgctataataatagagaattaaggttacggagtgttaataatgattgacaagtttaaaacaggaaatcctatctgggtttactataatgatattgattcaggagcaaaccttaccgtcccgcaattattacgcggattcatcggtcaagaataccaaattgaacaaaagcaatttcctaattaccgatatgtaaaaactgaaggtgaaactaagggaacatttgatatgcggcaacgaattgtacaccttttttatcggaaacagaattggggagaggtccaatcgattgaaatgtacctccacctcgatgctccgacacaggtatttgatacagctggtggaatgccagtcggtgccccccttcctgctgatattacagttaaatctttccaccgggttgcgactaagaatggtcagttttggtatgaaatcggcgctgaccaatggattaagtacgatcaaatgcacgttgttgataatccattcaaccaggatatccggaaagaaaagtcaaaactcattaataatttaacggtaattcccttgaagaatgtgcaggccaaagtcgattatctccataataagtcaatcaatgtttatgatgcgccttatggaaataaagtggcagagattccaaacggcgaaacaattaccctaattggaaaattaaacgataatgatgagattacctggtaccaagtgggccgcaagaaatatattactagtaactacattcaaattgaatatccagaagatgatgaataaaaaagcgagaggttgagaaaaagcaaaaagttttttctcaacctctcctatttttacaaacaatagcaagataacgtggaactagcttcgcatcaccacaaggctcaaggctaattctcacttacttttattaatcccgtcgtaattgaattttattattaaagaaacgcgctaaagcataaacgatgattaagtaaataactaagattacccaaccagtaacgtttgagattattattgatttaaagacaccgctagcagaaagcgctgggattaagccaaccagtgaataggctaacatcatcaataatactaagcacgccatgggaagcccaattcctacaatccatttccaccgacgatttaataaggcaaaaccattaccaattgccatcatcgttaaagaaagaccgaaataccataaaagactatgccaagcagaagcaagatcaaacggtgtattcattaaacccacaagttgggcaataaaccaaactactaatgtcattaggaaaagagataagattcgtccttgccatagtgttttacgagaaataccgttttgaattgcccatttaaagtcagtataaggagttacaaggaaaatcgccattaaaagcacgcttaagattgatgaagcaatgcttggaagggctcggaggctaaccaaaaaagattcaaggttgtgtgaaataattaatccaagcaagtaggttattaatgcaattcccagcccccaacctaaagcaattcctgtagcgtgacccgcttgttgaaacatggttgaaataacaaggtttctcttttgattttccattagtattctcccccattcgttaagtaaatgaataaatgctgcaaatcataatggccaatcttaacttgatcaggaatcacacgctgttcatctaagcgatcaagtaagtaggcagtcttaatattacccatcatttctgttttaaggacttttaagcctgcagtatactcatcaaccattttttctgggccactaattgcataagccttagctaataaaccttctgtatcttcattaataatgatgcggtgttgatccatgatgaggacatgttcgactaattgctgattttcttcaattaagtgggttgataagacaaaagtgcgtggccgttcttgataagtcttaactaattctttatagaagctatcacggtgattagcatctaaacctaaaatcggttcatctaatagaacataatcggcattgactgctaaggcgacgattagcttggaggccgtccgttgccccgtcgataagttagtaatcttcatccggtcattcaagccgaataccttgaggagacggtgggctaagtcatagtcaaagttattataagcggcatccgctaagtcaaaggtttgacttatcttcatgtgacgcggataaagattaatttcactcatcaaaaagatcttgctgagaaggtcatcattgttattaacatcttcattaccaatttgtacttccccgctcgttggaaaaatccggttgctcataatattaagaagagtcgtcttcccagccccattccggccaaggagaccataaattttagcaggttctagggtaaatgaaatattatccaatactgtttggcgatgatactttttgacaatatttttaactattaattgatccatcattctcacctcgttcgattaagtctaataaatgctgtttggtaattccaagcttacccgcttcaactagtaaactctttacatagtcgttataaaaactttctttacgttgttccataattttttgttgtgcacctttttttacaaacattccgagcccacgtcgcttttctaagaggcctttattaaccaaaatattcatccccttaagaactgtcgcaggattgatatgcaattgctgagaaagctgggtcgttgacggtacctgcgaaccttcatcaaagcccccagagaaaatcatctcttcaagctggtcagcaatttgctgatagagcggcgttgaatcattaaagtcgaaattcataagtgcacctccttggtttgttatttggttaatcacttatgtaactaagtatatatgttggaggatgatttggcaaggggaaaagtgagtttaaaaagaaaaacagttcatatccgaaattggatacgaactacttggtaaacaagcgtatcagtatttctaattaattttcactagttaccatatctttttttgcccatttaagggaagcagtagagttaactgttaccggctcgccatacttagtattattactatcaacggaatcaagccaaaagtcataataataatggttaccatccgctgtcttataatcagcagtaccagttatattttgtggtaagttttcttttaacttgttcagagtagcagtgctaatatttgtcccctgtgcaccagttaacagttgctttacactcttagtatttatcaagggcatatcgataccctttgtaagttgttctcctgcctttaatggatcggtgagaacaacttgcttaccgccaacctcattccacactttagaaacgcgaatactaatcggtgatgttacctcttgaacaccaggttcagcatcaactaccaccgttgctgaatacttagcagtcaatggctggccgtatttaacatccttattatcattgacaaattcgactactctatttgcatcgccttcgatccagtaaacataatgatacttggctccattagctgcttcataaattggtgaggagataccattacttagttgattagcaatctgggttaaggcttcttgaccgattacttgattgctttcaccactcaattgcttacttactgaagcattcaaaaattccttattatctaagactttcccggtaactaaaccatcattgggctttacatcggtattattccaaatcttagtaacaactgatttaagtgccgactttacttgttcaggactcttgtaaccctcaagcattcctttataaacgtttaatgattgaagcgggtgaccttgatcatcaaatagtgcaacattatcccaggtagttccaccccatatagtctgaccattgtaatacatcactgaatctggagcataaccaactgcattctttgatgcccaaccggttccatatacatcagacattttcttattatagtcccaattttgccaaccagctttatcaggaatccacctactccgccttgggcaactaatgctttatacatatcttcaattgcattaacctgcccttgcggatcatgactatatgcttgaatctcatcattagcactaatagaatttcctgtcccatcggcatcattgacattattaatccagcctgtttctagtacaacagttttcttaccaaatttccgccaagccatcttttcaatcgcttctaagttaattggtgtacttgcgccatatcccagatcaacattgtcataccaactattaccgtcatgagtcgaccagaatgggtaataagaagttcctaggtagtcatactcgacattattattcttcaaaaccgtcataatgctacgatacttactaatgtttggtgtctcaagctgaatggcaatcttggcatttggtaatactgacctaactgctcctgacgcggttcctaaatatttagcaacttggtttccttggtcactttcccatatagtcgcccagttttcaccatggtcacggccggtccaaataccaaaagcaccattagttacttcattccctacttgaaccatttcaacatcagcgccggcctgcttcaaatcgttaagaactttgcttgtgtataaacttatctcttttgtaagatcagctgacgataaattcttccatgctttgggaagcggttgcttagctggatcagcccagaaatcagagtagtggaagtcaactaagattttcattccatattgacttgcctcactagccatcttgactaatgactcttcatcattatttccaccaccataaccaaagccttctgcattgtatggatcattccatagacgaagacgaatccagtttacaccagcatcttttaacatcttaaacaagttagcttcttgaccattaaagtcatagaatttaacaccagcattaattaaagactggtaactggaaatatcaactccacgaatcatatcatctgacatgtttggaatcttctcaacagtaatactatcataacggagaccagtatcagtacctgtcttatatgctaggttgagttcttcagcagtttttcgactggccggggtcttatcattagcagtgctcttagctgcaccccaagttaaagtagcagtatacgttatcttaattggatcaccatacttaacaccattattagctatcaagaaattatttaacttctcagtagcatcttttccagctagccaaaattcataatggtaagcatccccattatcggcatagcaattctttgcaccatctaaagcatattcattacctgctaggccagcaaaaattgcttttaacacatcatcagagattcgagtgccttgtttaccttgtaagaattcactgctaaattgagtaacgccatcttttacatcagcattacttaagttgtcgttaactttaatggcatcttttaccgttacactgaaaccggcagcagggtaaaacggtactgatagtaacgtttactggcgaacttgctttttgagaaacattttcttgacctggtttaaataaaacaatcgctaactgatctttgcttgcatctgcccctacgcccaataccgaattattagcatcagctggattaaatgaattgataaaccgttgaacaagtgttgataggtcaacattattaaagttagtggtaaatacagataatacattacccgttaataacgaatttttctttagcttatcagcaatacttgccttatttgctttagtatcgccctgtgctacctcttgggctaaatcatgtaaggctaattcacggtaattatgatctttactttgccaatcatattcaacattttgaatattttcattatttaatgctgtggctacctgcttagcaacagtatttcaaatttcagaaggatcatttacttggattgcttcaccattaacattgaaatgatagaatttaccgtcaatgatcttctcttgatcagtgagcataattccatcattatcgaaataatactgtttaccatccttatttaagaattgactggtataacaagcaccatcagctccaaagtaataagtgtggttatcaatattcttaaattgatcatggatattaagaactgccccattagcatcgaaatagtaatacttattatcaagtctctcaaagcgtgaaatagcttgctgaccagctggaccaaagtacttattatctatccacttattagttacttttaagtaagtcgtcggatcaaagtaataataactaccgtaccattcctttaaccctgtaacgatacgaccatctgggccaaacatataccaatcgccccactgagattgacggtaatcattatctactcgcaaataagtattcggatcaaagtagtaatacgtgccagcccattggtaaactttagtaacaatgcggccatcgtgaccgaacatataccaaagcccctatagtcattgtctactcgtaaataagcgcgtggatcaaagtagtaatatgtgtcagcccattgctgtacaccagattgagcaatcccattatccatcaaataccagtttgtattccactgaacattagtattaggaatagttggtaaattaacgtactgtcggccattcagtggttttccatcctgataataggtcgattgaccattttcatttttccaaccggtcacaattgtctgttgctcgttatcattcacttgcgaagtaaccgttaattgattttgagtagtctttgactgtgtattcgtattttctttattaccatcttctattgataaagtggcggttggggctgaagtgcaagaaaaaagttagacaaaattaaaatattaagctgctaaggcatgatttcggtattcgaccggagtcatgccttttgcttttaaggttgttctgacatgattaaaatattgaacatattcttgagaaagttcgcttaattctgcaatatccttacaaggcagaaatcctgctagtaactcagtcttaaataagtgaaagaaactttctactggagcgttatccaggcaattttccttccgtgacatactttgaataaactggtgatccgccaatttttaagtatagtaatctaactggtaatgccagccctgatccgaatggataattgggtaagcattatcaggtagattggtaattaattcttctacggtttttacaatcagttctttattcggaccagtacctatttgaaaagctagaatctcttgacttgcttcatcaatcatcgctgagatataagcccactgatgattagctaagcggacctgtgtcacgtcagtatgaataacatgatagggacgtttttcattgaagttttgttttaaccgattgtccgcaatcttaccaaccgtaccatgaggctgggaattaactattaattcttgattctctaacagtaaaatccggactatgatttttgatcgaggcactatcaagtatacagtttaaatagaaaaatagtttatgcggcttgagcgcggaatttttctgcgctcaagccgtttttagatgtataagctcgttgagtgttgaaatatttaatagcttcctttactgattgttctaattccgtcaatgttttaggccgcgaacgtttggctaaccaaatgagcttaaaatcattccaccagcgttccatcggcgagttctcccaaggatggcctgggtgtgacatgctgtgaatacagttttgatcggctaaatagtcattaaaagccattgaacaaatgctgatccgcgatccgtatggatcagcggatgggcatccggttccactttgaaggcacgtttaaatacctcaattgctgacactgctgtttctgtgggtgagatattgtagctcaaagcgtaacgtccatacaggtccaaaaccacatgcacgcgagccttctttacctgatctatcccgtacagaacctctgtagtatcggttacccaaacttcgtttttactctgacgatcaaattgttcattgagtaaattatcattgatatattcttcataacgcttaacgcgattatgtctcttcttccggatattagccctgattccatgatttctcatacaattagttgcccgctttagtcccgccttgaagcttagtttattttcgaaggctagttgcgttgtcatcgctaagtaacccagtgtccacttatgtttttcttccaattctagaattgcttcaagtagctctgattgttcaactttataattacttggctttctatgaagccacttgtagtaagcatctctagttatgccagcgatctgacacaagacactaattggccagtcatgttcttgactcaattttttgatagcttattgtttgaagaatcgttcgcctcccgattgcgtatttccattactttttttgagtaggcatcttccatttctttacgaagaagttgggcctttagtaagcgattttcagcttttagtcgatcaacttctgtccatgcttccttcggcttggctttaccccgccgatcacgaagtgattgcgggtcattaccacttttacgatatttttgataccaaccatagacttgttggtaactaacatggtacttacctactgcccaattgtagttgatatcatgtttaatcagttcctcaattatcgataatcgttcttcaaaagtagttttccgtcctggcataattgaatctcactttcttggcgtataagccttcagttttgattcattatactggataatccaatttgataattgtctttttgattttaatccatgtttgattgcgaatacttcaagggaatctgttgattcctgatattattgaaccaaagccagcttaaattcctttgaatagctacaattgtggtgagtagatcgcaatccatcaatcccttggtatttataaagtaattgccaatgtgaaatggtactgtcattaactaaatactttctagcaacctctttaacactagaatgacttaattcgtttaatatcgatagcttttcttctgtactatattttgaattcctacccacaaaaaatgccctccaagtatataagatgaattttctatttcatctgtatacttagaagacattatagcctcgatccaaaaatcgtagtccggattttaaattatttatgaaattagtctccaatcgactaattgattggccaaatttcgttagatttaatgccatcagggctagccccatgtcattttccacagcccgttgaccacggagatgagttcggcgtatgctaaaatccctcttcatgtgaccaaagactggctcaacgtcgaactttcgtcgacgataaattgccttgccttcgtcacttgagggggtatctttaactttagctttataataattccaggttgggttaaccttcatatagcgttgacgaccacctggtgtcttcgctagctcatctaatttgactgatagttgatgtttatcagcacgatagattttaaagttgcgcttaaagccatacttatcagtggacttactgtagcgataaaaactaaaacgaactcctaaataatcgatgtagtaatcatcctcggcattatactgccaattttgtgatttagttggatcgtttttaaatttacgtttctgttccttttgataggtggtgtatgggataaccggctgcttttcaaaccgatcaagaatcattgtgtaattgtactcactaccatagcctgcatcggcgacgatatgttcaaagaaatctaaagcatgaaactgggtaaggaatggcactaaggtcctggtgtcagttggatttgaaaacagcccgtaatcaaggacaaattgcttatgggtagcgatttgcaggttatagccgggcttcaactcccgattcatcattggatcttccttcatacacatgaaggtcgcatcgtggtcagttttggaatagctattacgaccttggaagatattttcagcacgttcatactttttggcacgcggaattaggtcgttgcttaattggtgacgaagcttttttagaaaacgacgacgccgttttctaactgaaccacctttgatgatttttggttcttgcttaatctcctcatctagcttagtgattttctccgccagttcttgtttcattacttccatgccttcggcggaagtaaccagctccggtgccatttcttgcaccacttgcttttctactagtttctcataaagcttacttgtcttttctcttaacttagcgtgatacttttcaactgcccgtcgccaagtaaatgaatatttattggtatcggcttctaccttggtcccatcgataaaaactgcatcattttgaattagtccgtgatctttcaaagccatggtaaagtaaacaaaggcatgtttaattagcttactagcgtgctgactgcgtcgaaagttattgatggtatggtagctataagtataatcatgagctaaccaacgcattggcaggttctcatccaacatcatttcaatctttcttccagaatacgtaggcaaacaagagaatcttaagcataattgctggatgcgatgaagggcggccggtagctgctcctgaatcttctaatagcacattttgtggaatcgagtcgacaaaatcactaattagccgcgcaatatgattttgtggtaaatcatagttatagtttagtacgaattcggtttgtcctatggtataattttgatacatgaaaatcgctccttttggttgttttgtggtaattacatcatatcaggaacgatttcctgtgtacataaaaaccggatgatgaattgttcaaaaaattcatcatccggtttttattttggactaggagtttttccccagcctcttacgatggcgattatataaggttacttgaatatttaattcccgcattaacttgcgaatagtatccccactcaggtgtaatcctatttgatccagctccatttgaatacgacgatagcccgcggcccaacgtccacgaagtctaaaccgttgggcaatctttagaatttgaactttagcttcttcgtatttgtcgtgggagtggacaattcgtttacgttcatcatgataggttgccttggcaagcccaatggctttgagaagatcgccaatcttatagcgcagtttctttggtcgctgtgattgatcgtccctgatctgatccactatttgagttttcttcccggctttgatggtccgaacagggacagcgatttttttaagatatcgcgctccatcttagtttcataaagttcttggttcttcttcgctaattcttcctttaatcgttccagctcactcttattagcgagctgatgagcctgttttttagtatgtttcactttagacggcctacctttcgggtgaggcttcaaagctgtaataccgtcccgttcaaattgcgagcgcaagctcgaaacttgcgctgttaaaatatcaaagcgagcggctacttcagccatcgaatcctcatgagtttggtagtagtctatcacatttagtttaaaatcggtggtaaatattcgtttatgacgccgttttttaagtgcatcgatccccctcaattggtatctctgaatccattccgcaatacgccgcccactaatttgatatttcttacttaaatcattagtgctttgtaaagtcgaaaggtattcttgaacaatttgggctttcagttctggtttatatctggtcggcgaatttacaattgaaatgcaacacaaagtaaaaaataaacccataccgggtagaatatgtttaacgaccaaatcaaacaattcgaggtatccggtatgagctataaacatcttactataaaagaacgtgaaatgcttatgtttttacgagctaagaggttatctatccgggctgttgcgttacggctggggcgaaatccaagcactatttcacgagaattaaaacgttgtgcaggtcattattccccaagtaaagaagaaaatgactatcatcaaaagcgaaagaattgtcacaagaagcggctattagacagccatccacaactacgccgtcaaattgtttattacatcttagatctgcactggtcaccagagcagattaccgctcgctttaataaggaacatcaatggtgtgttagctacaacacaatctaccgtcatatctatcaacacaatttaggtgagaagtactcctcacatggcgataccggtattcagcgccatctcagacataaacatcggacgcggtattcaaagaatactagacgacatcgagaagtacagacggactacatctcaattcatgagcgccctggttttatcaaccagcgtcaacgtattggtgactgggaaatcgatactgtgattgggcgaacgggtcattccatccttttaacggttgtcgatcggcttagtcggcttacgcttatcaaaaaggttgcgtgaaaggactcgcaggagataaataaaggcttagttgaactgttaggggccattcctaaagaatttgttcattctattacaccagatcatgggaccgaatttcttcatcttgatgaaatcagcgaaagattaggtgttactgtctattggcccgatccatattcccctgaacagcgtggaacaaatgagaatacaaatggattaatccgggaatattttcccaagcgaacagatattgataattatacagaacaggacgttgaacactgccaaaagcagttaaatcaacgtccgcgcaaagtgttaaattatgaaaccccatatgaagtattttttgacaaaccgttgcacttagtttgacaattcgcctcatacaaaaaaagtgcctcacaatcattagatttcttgtctaaccattgtagggcacttcatgatttattagctatttattcactaataaagatcattttcatattaaatattttcttggtttgcatagtaatctgcagacgatatagcatcaggcaatgttgttgcaaatgctttattattaccatcattcaaatatgcatagtaaccgttaggcattttaactgctaaaccaataccaacattctgtaatgaagtaccattttcatatttagctgaccattcagtaatgcgagtattcggatcaggtgccactcctgtggaagcagcctttgtagtaaacaagtctggatacttttgctttaattcagctagatacttaccaccataatcttgttgaccttggcctccaccacgtgtatagccaaagtagatttgatcggcaaacgtttgaccatcaacacttaactgttttgcatcacgatctactcgtgtaactgtaacagcttcttgagttgagaaaccaatcatctgattcatcacaaggtcttcttgaacctttaaaccagcctgatgaagtgctgcaatcgcattagaaagttcttctccattaccatatttagtaggattatctgcagtacctaaattataacgatctgtcatagcatatccctcattatagcgactcgtattaaatggcgtgtaggaaggagccatccagaaatcagtaatacctaattgattaaacaaggctacattatcctttattacattataggcatgttcattaacggtagttggttctggctggaacaaggagaagtcttcataaatcatatgtgaatctaaggctgcattagaagtaaatacttttccaggaacatttcggacttcttgtgcacttgtccgagcattttgagtaccattaattaacggtacccaaacacttagatagccacttacataaggattactgtaacccttaaccgtaacccgtaaaatacccttactatcagttgtaaggactgatggatttacagaaccgttgctattataggttaatccatcagcagtactatcaattagattacgatattgttcattagcatgggcaagtcccatattaattgctactacctgctcactcattgacggattattcccgacaataacggccattccagtagtacgacttaatggatctgtaccgttgctcgatacatcgacaactcctttaccataccgaacactggtaataagattatcattcactttagtcattgtctgaccaccgttaacaaattcaccacgtgctttcatcagtgtagtaattgcatcataatacattgacttcgtcttcatatactgatcggtttctttatataaatcgccatagtatacctgtggaaccgtatctttattacttaatagcagagcatattgtgctggcaagttatactgagcatatttcttatcagcctttgcttgatctgcatagaattcatcccatgctttttgagcataagtcgacttatagctattagccataatatctggaatattaggatgattgtcaataataatttgattaatcacattctttcgctgatcatgattagttacaaatgaccagttaggcgtagcggtattctcagtaatatcattagctcggttaacgacactattggttattaggttattaacattgtctcgtttgttttcagcttgtcctaaaacattttctaatgtatagaaatatcccgcatccataaataattcaggatttcctttatcattaagcattctagcagcacctgagtggtaaccttcgttatatactaaatggttgttagcattttcctggttacccttcgtatgatacatatcattaacaagttgtcccaattgatccagcacatctgcatcaatgttatctgcagcatctacccggaaaccatcaaaattaccatcagcattatacttcattagtttaccgtaatttaataggaagtattcccaattaaagttttcagcttggacagctggatttgaattatcaatatcattaccaactaataattctggactctgatcactattatcattatttgtctgattattaatggttctgttcattaaacgataattgctatcagcatagctagtattacccttagcttgattatctgaattgttattaataaagattagctggttattatcaattgaaccactaacatctggaacatagccattgctatattctaccggcaattcagatttagctgataattcaggaatcgttagcataaacttattaatatcatttgctaatggaccagttgacttattagcagcaatactcttttcgattacgaagcgaagattacgagcatatttatttaatgtttgggtatcagtatcttgcgaaagattagttacgttatccttagttaatccataatcagtattggtatagccattatcaacaaagtatttaataaatttggcttccacatctttacttggccatgtatacattaataatgggcgccaatcactggcagttgttttataccatgtcttaccatcttggctcgtaccataaggacgataccaaccagaataacttaggtaaccatcagtattattaattgatgaagaatcctgactataagccatattctcccaatcacctgaatcaagagtcttaatcagcttattgcttaacgagtcatagatattaaacttgccatcaacaatctttccataaagatttcctaatagttgaccatttgatgcgaagtggtagttcttaccatctattgtttgcttaccaactaatgctgcaccgtcggaaccaaagtaataagtgtgagtgtcgattttcttgaattggttacgaataatctgaccattgccatcaaaacaataaaatttattattaatattttctaatgatgaaattgcttgacgaccatctggaccaaagtatttattatcaatccacttatttgtaaccttaagataagtagttgggtcaaagtagtaatagctaccataccattctttcaagccagtaacaattcgaccatcagggccgaacatataccagtcgccccattgagattgaacataggcattatcgacccgtaagtgggttaccggatcaaagtaatagtagctaccagcccatggagcaaccttacttgctgctgttccatctgctgtaaacaagtaccagttaccattattagctttgatataattattagttactgcaaggtaagttacaggatcaaagtaatataattgattatttttactccatttatatagaccagtcacaattcgaccatctggaccaaacatgtacttagatccccattgagatgttacataatcattatcgacccgtaaataagttgtaggatcaaagtaataatatgttccagcccatcgctgaacaccactttgaatccgaccatcattaccaaagaggtaccaatcaccccattgagattggagataagcattatctacacgcaaataagttgtgggatcaaagtagtaatatgttccggcccacggataaactttagtcacaatccgaccatcgtgaccaaacatataccaaagtccccattgcgactgacgataatcgttatctacacgcaaataagttgtaggatcaaagtaataatatgttccggcccactgttgaacgccagataatacttgaccatcgttgccaatcaggtaccagtcgccccattgagattgaacataattttccttgttagcttgaagatgagttacgggatcaaaatagtaatatttaccattaacactttgaataccggatagagctgccccatcgtttcctagtagcatatttcctttagaagtagaaatatacttattagtttcacggagataggttgtaggattagcataatacgtatttccattgtaatcataaagaccggtaacagctcgtccgtctttaccgaacatataccaatctccccactgagattgacgatattcattatctactcgaagatatgtagaagggttaaagtagtagtaagaaccagcccattgttgaacgccagattgtgcaataccattatctactaaataccaattattatcggtttggacatttgtattaggaattgttggcaggttcacatactggcgtcccttgagaagttgattgttttgataatactccatttgcccttgagcattctttacccaacgattttgttgttgattagaattatctgctttaggattaattgatttagggctttgaactttttgtgctttttgattattagttacgtcattagtacttgcgttagaggatacagatttaatattttcactcgtttgtgcagcaggctgattgacagcaacattatcatttgcattggttgctgaatcagcacttgctaccccccctaaatttaaaataaggccagctgaaactgcagtaataatggctgcagtaaaccattgcttaccgcttttatatagtttaaaatgcttttttatgtccataatctattttccttcccaatagatgattgattagtatttaacaaagacaatataactcataattacaatgttttcaattgaaagtttgctccaggctaacgtaacaaaaaagaaaatgcccagtcctattgactaagcattttgatttctatttattataaaattcttcttgcaaaagttggatgataatatttaatattagttatctttacattttgtcctttcgtaggtgcctggataaagttgccatcgccaatgtaaattgcaacatgataggcattcccgtaatttccccagaaaagaaggtcacctggctgtaatgaatttagactaaccgctttaccctgatactcttgttgataggttgttcgtgacaaacttatgcccacttgtcgatatacatattgaactagtcctgaacaatcaaatgaattgggcccgatagctccccaaacataaggcatcacaggttgtttagcaattgaaacaacttgtgatgccttatttgaatgagcaattccttcgttatcaaaataatagctagtaccatcgattatcaatgtttcattagttgcacgagtaccatcagatttaaagtaatacgaatgtccccaattgtaataccacttgttctgatacatgaccccactattatcgaaatagtaaactttattattttggtttaaaaagtaattagtttgcctttgaccattttgatagtaataattattaccattttcgttaactactccatttgtagcagcttgactctgaactaaatttactgactgaaaattagaagaaggtgttacctgcatattaatctgttgatcagatgtctgattattctcatccttctttactaaattattattctgactattattagttttatcagatactaatacagcagattgttgcatttgattatttggattagactcatcagcatttacaatacttatcgaaccaataagaaatacactacatgaaaataatgctgagtaccattttatattgcccttagtaaacttcataattagtcactcccaatcttatcaatcatttatattatagcgctttcacttctaaggatcgagtaggagataattgattagttcaattatcgacctctcacaccaccgtacgtacggttccgtatacggcggttcgacaacttaatcacattaaattgattggagcgtcttggacatattcataagtccgagttgttccagttttctattagttagagaatagctcaaggtcttactatgtgcagttcgccagtagccctttcgggtactagcgaagacatatgcatcatgctgggacagccccaacttctgtaagttagttaccttagttttaaactttttccattgcttccaaatatactgccttattcggaccctcaaccacttgtcaaggcgttgaataaagttagttagtttcccaattgagtagtactgaagccacccacgcatttttcgatgaatttcttcaaacattcttgtcagagatattccacgattacgtttagttaataacttcagtgctttctttactcgctgttgcgattgtttagctggacgggcgtaggccccattgtggtctacacccaacgaaaagccaagaaacttcaaccgtagcgggctaccgactttggttttatctggattcactttaactttcaagcgcttttctagaaactgtgtaatgcttcgcattactcgttctccggctcgttgacttttaacatagatgttacaatcatccgcatagcgcacaaagtggtgaccacgtctagtcaactctttgtccaactcatttagatagatgttcgccagtagtggtgacaatggccctccttgtggggttcctttttcactcttagcgaaaagcccatggtctaagactccgctagttagaaacttacgaatgagtcttagtgtccatgggtcatcaatatattgttggagatacttaatcatcaagtcatgattaacgttatcaaaataggcttttaggtctaagtcggcaactcttcgataaccttgattataaagatctactactttttcaatagcgtcatgggccccacggtggggacggaagccaaagctattatcagagaaaacacgctcaaagataggcgtaagaatttgggctacagcttgttgaaccattcggtccaccaccgttggtattccaagtcttcttactctaccattaggcttcggaatttctacccgtttgactggagctggtttatacttgccctcacgcaaactagcgatcagttccgtcttattttctctgagatatggcagaaggtcattgactgtcatatcgtcaacgcctgctgctcctttatttctcttaactcgcaaataagcctgattaaggttattgcgatccaagaccaggtcttggatagtgacactcatacctttaccttcaccataaccggtactacgcgcccttgtgtactttcggttttccaaacctatcctcgacaagcggtcagcttgttgttctgttttctgcgattgtcgcacctgattacacctccgatataagttacaagttattgtcgttcagtccttcatctgattattcaaactactatgacctcggctgacttctggcttactcaacactgcatcactgcaccgcttgtttctgtggaaattaaacttattcctcttgtcggaaacgtgtaggccagatctccccgggtaagaatattagctttcgtaccatgtcatcgttagctttactgagaccaacttcgagtagtattggacttcaacttgtctagcagccttatccagttaatttcagccttatagctacttcttgttcatcgatgcagtactttgccttagacttccttcagattccacctcacggtggacacccttgtcctcagctcatggttccgactactacggcccatagcggactttcaccacctagctaatacccatgccgggcgcacaaacaaaaaagctccttaattaatagggagcttttgttattgattaatgtctttagacctagttgagtgcgcgagcagagcgagtgcacgaaacaaaaaaccacctgctatgcgggtgggcgataaaaattatataaaaaaggcctcttttgccttaagatgtaggtgttcaagccaaagtcaataagggaaaagaggttatataaatatggctaataaattaaatagcttagcccatacgaagtggttatgtaagtatcacatcgtattcataccaaagtatagacgtaaagcgatcttcaatcaataccgaagagacctgagagattatattcgtttgttgtgcaaatataagggagtagaaataattgaaggtcatatgatgccagatcatgtgcacttgttagtaagtattccgccgaaactaagtgtctcgcagtttatgggatacttaaaagggaaaagtgcattaatgatgtttgatcgacatgcaaacttaaaatacaaatatgggaaccgacatttttgggctgaaggctactatgtgagtacagttggattaaatgaatccacgataaagaagtatatccgagatcaagagaaacatgatatagcaatggataagctaacaagtgtggaatattcggacccttttaagggtaagtgaggtagtataaacaccgcttaaagcggtggcaaagtagtcagagcattttggcttgagcaaagcgaaagccagcgccttgagacgccggcttttattatcggcttatagccgatgtgcaaaccacccgtttgacgggtggttatgattgatacaacaacattcttacattaatctataacttcgctgttaacttcacatcagggtacttttgcttaaaccaattttcggcgaattgattttcaaataagaatagtggctgatcatggatatccttgactaagatgtttcttgatgacgacatcttttcatccaattgatctggatcaatccaccgggcagtcttagttcccattggttccatgacaacctcggaattatattcattttgcatccggaacttgaacacttcaaattgaagctgaccaactgcaccaagaatataatcaccagtagaataactccggtaaagctggacagccccttcttgaactaattgattgattcccttgtgaaaggatttctgtttcatcacattcttagcagaaacacgaacaaacagttctggcgtaaattgtggcaacttttcaaattgaatatcttttttaccattataaatagaatcaccaatttggaagtttccagtatcgtataaaccgataatatcaccggcaacagctgtctcaacgttttcacgggtatcggccataaattcagtcacatttgataaccgcattggtttcttagtccgtgataatgtaacatccatcccccgatcaaattcaccagaacaaatccggacaaacgcaattcgatcacggtgacgaggattcatgttagcctggatcttaaaaacaaaaccagaaaattcgggatcaaggggcttaacaacatccccgtcctcagttttgtgatcacttggtgcaggggcaaactgtaagtaggtctccaagaaagtctgaactccaaaattggttaaagcagatccaaagaagaccggtgtttggtcccccttggcaatcttttcttgatcaagttcattaccggcaacttcaaccagttccatgccgtccattgcatcttgccattcaccatcaccagctaatgggttgtcgccctcaacattaccgtcttcatctaatggtaagtaaggattattttcatcagctggatgagtcaaggcaacacgatggttaaagcgatcatagattcccttgaactggtgaccagaaccgattggccagttaattgggtaagtctcaattcctaatacgtcttcaacttcatttaaaaggtcaagtggttcacgggcatcccggtcaaatttattcataaaggtaaagatcggaattccccgcatcttacaaatttggaataacttcttggtctgcggctctatccccttcgcactatcaataaccatcacagcggagtccaccgccattaatgtccgataagtatcttcagagaaatcttcgtgccctggagtatccaaaatattgatccgcttaccttggaaatcaaattgcataacagatgaggtaacagagattccccgcttcttttcaatctccatccagtctgactttgcaaaattaccggtcttccgtgctttaacggtcccggcttcacgaactactcccccaaaaagcaagagttgttcagtaatcgttgttttcccggcatccgggtgagaaataatggcaaacgtacgccgtttattaactgcttcagcaagttcttttggtgacattaaatttttcctttccttattttattctcgtgaaatatctctactatattattacaattttttatgaaagtctattcttagaaaaagttacagaaagtttaaagtattgagatatatttgaacttaggattaattttctgctatattaataaagttagaacttatttttattgaggtacttagtatatggataataacaataacaacgaatcgcgggaacattaccgtaaacggatggaagaacgtatccaacgtgacgttaatgaacgcaagcgtcgagaacgcgaggaagcacataataagcgggagaaccgtttgcgacgagaagaagaacaatcgtcacccgattatcaaccgcccaaaaagcatcactaccgaacgccgaattgggtgcgcgctttaattgggttattaatttgtctagtagtggctggcggattttatgaatatcataaagtgcactcagttgccaaaggggtgtttggcgctggtgatggaaaaattagtaaaaagttacaaaagggtgaaccagtttccgtcctggccatgggaacagatgtcggtgctttagatcgtggtaacaagggtggtaatactgactctttggaactatttactattaatccgaaaaagaaaacaattactatgactagtattcctcgtgatatcctagtacgggttgagactagtgatggccctgattacgttaaaatcaacgctgcttattcaatcaatgggccaaagcaaaccgtaaagcaagtatcagaattacttgatgtaccgattgattactatgcagttattaacatgggggttctcgaaaaagttgttaattccgttggtggggttgaggttaataacccatttgcctttgactacgaaggccaccacttcaagaaaggtaaacaacaccttaacggagcaaatgcgttgaagtattcccggatgcggtatgatgatccaaataatgattacggtcgtcaaaaacggcaacaacaaattctaaagagcgttattaataagttcaaggcttcaggttcaattggggcagctaacaagattttagatgctgttggggatggcgttaagactaatattccaattgatgatattgcgaccttgtatggtaactaccatggcgcaatgaacaatgttaaaacctaccatttccaaggacaaaacgcaacgatcgaaggagtttccttccagattgccagtcctaaagaaattaaccgggtatcaaaactggtacgagctcaacttggcttaaaggctaagaacgttgttaaccacgaaaccaagatgtacaagtcacaaccacactataatggttacaatgaaacagactttatccttcctggtggtgccagttacaatgatcctggtagtggtaatggaagtgatgaagttattggctcaagtagtcaccattcatcttctgcaactgaagaaagtgcaagtactacagaagaaaactacggaacaaccaatgcttatagtgaatcacgggctgttctaactactggcacagcaagctcacaagtaaggcgatattcaactcctcaatatcatagttacaataacggatacccttcaacatatactcatcctacttatgggaatcattacgggtatactcaccgttattattaaattataaaaaccatcttcgttaaattggtgaagatggtttttattactttaaataaattgttactgtttgcgtcgatttataaggagtgaagctaaccagtgtttctcctttaacactactttccactctaactccttttgtagaataatttctaccgtaattaagtacgggtaaaatcactttattaactttgcctttttggagattattgagcttatagctaattacattatattgagaaccaatttgattctttttaagatgtaccttcctaccatttaccactgctatatgtttatggacatctaatgctgaacgaaagacctttgccttatccatacctattaacgtttttgctggcatgtaatctgtataaacagcactagttgctatttcagtataatttttctgattagcaaatccaattccattagtatgagtatattgatacatataactaatgctgactaaacaagaaaccaagtacaaaagaacaattatactattagagtcccttaacttattaccaattaaatttgcaatcactaatgaaaagcaaaatgtgcttatccctaaaaaccgccatggaaattgtattatatggataggtgttttttgaagcaaaaaccatggaaatagtttggtagataggagtaaaaataataacccaacactttcaattctactcattaatcggtcttttgtaagataaactaatagtccaaaaattcctgcaataaatgtaataaagccaagatttactgctaaaaggtcattaggaaccatattatttactgaattaatgattaagtcactcggctttattgcttcattaataagtgtatctggaactattggaacaataattggtactttcattttggcccgtatcatcgttaataacattggtaagcaaaccaagaatgctaaaaaggcgcttatgactagtctcctagcaataagcaaattaatttgacgatgatctaaaaccaataaacaaactagaaaaaatgaaaaaataatagttgaaagaatatgtgcgtaaccgacacaaatcattcctattgataaccacaaccattttttagaattataatcaaataatttttcataccccataaaaattaaaggtagaaatattaatgcaatatactcagcaatatcaccacgttggcttatttgtaatagtaaatatcctccattgttatataggatactaaacaaaaatgccactttcttcgtgccgaaaatatctcgcatcacgtaataagaaataaaaaacgaaactagagttattaaaaaactacatatattataagcaactataggatcaacgtatgtaccccccctcaatattgaaaaggggtataaaaataagtacggatagaagtgattaattgctaaaccaatttgtgaaaaagcatatgtcccagtcgatgaaaatatatgtccagcttggatgcttcgatataattcttcgattcgatttaagtgaaattgtgtatcccaccccaaaggaattactttcattttaaaaagatatgcataaataaggagggcattgatagtaaaaaatactatatagtaatatttgctataaagctttctcatcgtcttcttcctccaatggatgttcaatccgataaatatcaaagaagtattcacaaaccgttttaatcacggcatagaatgggatacataaaatcatcccacctactccagcaatatggccggctgctaataatagcataatgatagtaagcgggtgaatctgtaatgttttcccaataatattcggataaataatgttcccatcaatttgttgaacaacaatcaccacaacaatcacccaaatcaatttttcaggagccattgtcaaggccacaaacaatgctggagcaattccaatataaggcccgatataaggaatgatgttggttaacccagcaacaattcctaaaactaatgccaaaggttgtccgattatcatgtaaccgattgaagtggtgataccgacaaataaacattcaatcatctgtccagaaatataagatgataaagtattattcatcttagttagtagctcattaacttccttagcatgatgcggtgatagccacttttggatacttggacccagctttgaaccatccttaagcatgtagaaaagcatcactggaaccgtaattgtcacaacagtaatattagttactaccccaacaatatcaccaactcgttcagataagccctttaaaatagtttgtgcataaccagcaatttgatgatcaaactgacgataataagtgttcaagtcaacattacgcaagaacgaatgttgaaccgtatcattaattaaagtctgaataccactaaccgtttgcggcatgttacgaactaatgaagaaatttccttaacaatagttggtatcaagagagaaattccaccaataataattaaaattaaggcaataacaattaacaaactggcaattcctctactcatcttgaacttaccaatccgtagttttaaaaataattttaaaaccggattcagcatatagtacaaaaatccagaaatgatcagaggcacaaaaacaacagaaataaacgttaaaaatggctgaaaaataaactggatttttgtacatacccagattaaggtcgccacagttaataacaaaagcggccaaaatagccaatgataaaatttttgcttagacatagatactccttatataaggtttaaaataaaaatcatctaaaactgtaacatagttttagatgattttgtttaaaattgaaaagttttattattctttcttattctaaattatttaatcgtctcaacacgaacaccatcactattgaagacatatgttacaccgttaattgtatgacgaccagtgtaggctacgccgtcggtaccaaagtaataactcttctttgcgttatcatcattgaaccaacgattctttaacatattaccatttgcgtcaaagcgataaagacgaccataatcattcaagaaacggttttgataacgtacaccatcagcaccgaagtattggttgtttacccacttatttgtaacctttaagtaagtaattggatcaaagtaatagtaatttccgtaccattcttgcaaaccggataagaccttaccattattatcaattaggtaccagtcaccccactgggattgaacataattacgcttgtttgcttgaagatgagttgttggatcaaagtaataatatgcattattcatactttgaacgccagataaagctgctccattatcaccaagaagaacgccacggccatcttttgcattcttaatatacgtattcttttcacgaagatatgttaccggattagcataataagtattacctttgtaatcataaagacctgttacaattcgaccatcattgccaaacatataccagtcaccccattgtgcctgacggtaatcattatcgacacggaggtaagttgttgggtcaaagtaataataacttccagcccattgttggacaccagataatacttgaccactatcaccaattaggtaccagtcaccccactgtgattgaacgtaattacgcttattcgcttgaaggtgagtagcgggatcaaagtagtaataagcattattccaatactgaataccagataaagctgccccatctgcacctaaaagtacaccacgaccatctttttcagtttgaatatacgtatttttttcacgaaggtaagttactgggtttgcataataagtatcaccattataaccatataaaccagttacaattcgaccatcattaccaaacatataccagtcgccccattgagcttgacggtagtcattatcaacgcggagatacgttgttgggtcaaaatagtaataacttccggcccactgctgaacgcctgattgagcgacaccatcttttacaaagtaccagttagtatcaccttttacatttgtatcgggaattgttggcaattgaacatattgtgtgccttttacatcttgactatctttacaactatatacccattggttattagtatttttcgtccaattagttgtttgtggggccttattttcatttggctgatcagtagttttttcagcaccttgtttaccatcagtttggccctgagactgatcaacattagtaaccttgtttttgaacttatcggttgtttgatccttattggtaggtgaatcagttatgttcctttctgtatttcctttaactgttgttgcttctttaaaagaattattagtctggtcagtcgtttgtgtttgttggatagtagtattagtatcagttgttgccgcagacgcattattaacagacgctaatcctagcgttgccacaaaagtaagcaatagctgtaatacaccattgcttaccacttttatacaacttgaagtgtttttttgaagacattatatattactccttctttgatatttacttatacgtaaatcatatcacgaactcgtaatatttgtaatcgtcgtttgtaaaatgtatctgtcaagttttcataggtagcctttaaatatacagttttagtgggttagtgccttaaaaagttatcccattggtctacttgtggccgtgttaatcggaattattccttgtactgctccaattgacggctttgtcggtgcttttcttagaaactctccagttcgaatatgcatttcctgtaatagccttgtttgagccactcgaggaagaactgttaattgttctaggattgtatttaaactagcttgcagttcaccattcattcgggcttcaattaaaccaatcatggctttagccccctgctcagtccatgacttgccctgtttcttcatccggtaagtaaaagcccggtgagaactttcgactgaaccaattaaatgaatatccttaaatccacgcatttgtggcgagaggatataccgccaatttcgctgtagatattttcttaaacgcattaagtcgtctgcttgtttttccgttaggttttgtgattcataagtatctaaaattattgttaactctgcttgatcatgatgacgaacggctttaattgctcgcatggctaattcgttgtgccggcctaaagtatattcaattttctgtaaacaatgatagcggtcgagaaagtattcaccatgtgcaccttgaggaactagacttaatagcttagctggttcataacctgggccagcgtcactggccaaaaagaccgtttgaccggcaagcttataatggcgggctaaataatcacttagtcgtgcttcaagccgtccttggtgcccaacactgagaaagtcatgccgattaatgatttgattagctatctgatttcctaactcatgcacggcgtgcattaccgaatcggcagtaattccgctgtcaaatacaaggttcaaaatatcggcagtgttgcgcattgtggttgtttgggcaatcttagccatcatcattaagtagtgcggcgataaacgacgacgtggtttaatttttaattgttggtctaagtaaaattcacgtttctttgtcccagcctgataataccgtcgttgaaaagtcaccgggccaaagataaagttaagcgtctgtggctgtttattgattacttgatagttcgctggagtttgagactttaagcttcgatctaagctttccaaaaagttttgcatgattgcttgtcctaactccagtaccccttttaaaataatctgttcagcttcaaataaactgcctgatttcaccaaattctgctcgatttctgttaaaatatccatgaggaaagacctgcctttgcttagtattcgacacacactaaaggctactggtcttttctttttttgtaaataagtaaattggtctacaaaaaggatttccacgaccagatgaattattcatccaacctatgaaaatcttacactaacttgtaaaattaagttagaaaaaataaaaagccatttgtgatagacttttgaatatccctaatcaaaagaaaggcaatcacaaatgacctataaacatcttaccacacgtgaattaactctcatagctgatttttggtatcaaggtactaaagcttatcgggctgctaaattacttcagcgtagtcaagaaaccatctatcgtgtttatcgtttcctcaacgacggtaaaaccatcgaccaatatcttcagacttatcagcgacataagcgtcgttgtggtcggaagcagacccaactgccaactatcgaagttaactatatccatgcgcaaatcaaggcaggttggactcctgatactattattggtcgtcatgaacacccaattagctgcagtatgcgcaccctttatcgcatgtttgcccgcaatcagtatggcttctccgttaaacagctaccgatgaaaggaaaacgctatcccagtggctatgtggaacatcgtggtaaagctggccaattaggacgcagtatctatcaacgatatcgtgattttccgcattaccaacatgaatttgggcactttgaagctgatacagttcaaggtaaagctcaccgcggagcggtaatgacgctagtagagcgacaatccaaagtaatgattgtccttaatattcatcataaaacagacgaagcagtgaattgccagcttgatcaatagctcgctaaactaccacgtcactttgttaaatcaattacttttgataacgggaaagaatttgctggatggcgagaaatagccaataagtatgatcttcacacctattttgcggaagtcggtgctcccaatcaacgagggttaaacgaaaataataacggcctcttgcgtcgtgatgttcttagtaaaaagctagattttcgcgatttaccagacgtgtacaataccctttagggttgacactttaaataataaaagtgccaattctagggggtgtttttcgtttctagttattccacaacagaaaaattaagattactaagtaattatcaggattcagattgctcattaggagtattcgctgactatcacgaagtgagaacagcgaacatgactaaatggattaaacaatttttattagcaggactggcaggattaattcgtcctaaacataaccaaaaatattcacttaagacaaagattgccgcggtgaaagattatcagcttaacggactggctagtcgtgaggttttaattaagtacaaaatacgccatatttctcaactaaaacaatggattatccagtacaatagtgacaaactaactgttgcttacgcaacaagaaagcgagttaagaaaatgggccggaaagtatcctttgatgagaaaaagcagattgtgcagtggacgattaaccaccagaataactataaagaagcagctagtaagtatgatattagttatcagcgggtttattcgtgggtacgtaaatatttgcacgatcataattgggaagtactaaaagataatcgtggcagaaataaagataaagaaccgacaaatgagctcgaacggttgagaaaacgagtacgtgaattagaagctgagaaacgagaaagcgaggtacaaattgcgttcgcaaaaaaattagtcgaaatacgcaatcgggaggtgcatcgaccggacgatatcaagcgattcaagaaatgattaaagacggttatacagtatcagaactagttaaagcggctaaagtaagccggcaagcctactataagtggctaaaacgagaattaactactaaggatatccaggatcaagagatccttaatttgattaaagaaattgagaaaactaataagcaaagtattggctatgggaaaatgactcgtcttattaagcgtgcaggtcttggatatttggtcaacaaaaaacgagttattagaattatgaaggaacatgggattaaagctgactatcgtcaagctaaaagaaaacgcgacaaggaacgtcaaacctatcaagctgaaaatatacttaatcgtcaatttaaacaggaagcagctaatcaggtttgggtaactgatacaacagaactcgcctacaatattcataattataaagttcgtttacatgtggttcttgatttatatggtcaatttccaattagctagctaattaccccaacagaaactagtgagggagcaattcaagtattcaagaaagctcagaaacaagaaggtgtattagccccacttattcatactgatcgcggagctgcttatacttctaaggcgttcaatcaatatttaactagcaataatagtcaacatagctattcagctcctggtacaccagcagataacgcagttatcgagcactggtgggccgactttaaagcaatttggctagcgcattcatctaagccacaaacacttgatgaacttcaaacactagtggctgaaggaattgaatactttacaaatacatttatttcagctaaaagaaatgatgtcaagggcggttttaaattgtcattttatagcggtttaaaaatgtatgatttggtcggtttaagaattgaccgatgccaagcgatatgactttcctttgatcttaattacgtgtgagtgatatacaaggcgatctaaaattgcctctgcggttgccgtgctatggaggacggctccccaacttgataatggtacattggtcgttatgatcgttgatttacgttcatagcgaccatttattagttgaaataatagttttgcttcttccgccgatattggtaaatagcctaattcatcaatgattaacaggtcatacctttcgtatcgacgcattacgcgctccaagtgttgcttctcttgagctgctttcaatctaagaattagttcatggcaattaataaatagtgttcgtacatcttgtcgacatgcttcgataccaagcccaattgacagatgtgttttacctacgccagggctgccaataaagataatgttttcttgattgtccagaaatgacatagtcgcaaattcagcgatttgttgcggattaattgaaggctgaaattgataattaaaatcattgagtcgtttaataatcggaaatctagcgcgtttgattcttctctttaagctttcctgttgctgataggtaatctccttatccgttagttttaacaatgcttcactaaagctaatttggttatcattgacttgttgacgataatctgcgattgatgcagccatattatgtaaatttaacttcgttaaattatctactaatttttgatattgattcattttattccccaatctgatcataaatactaagattattaagcatatactggttaatttcttcatccgttttatctttcatcaaatcacttttaagaatggcatgtttatcatgaggatcataattaaattgcttattggttaaatcatgcttttgaatctcagtaccatgatagaaaatgcggatagtcttaccatcagttgtcggtttaatttcgacttcttttccgatataattaggggaaacagagtattgatggttttgaaatctgatcattgagtcttgggatacctttctagtttggtcgctgttaaagtatctcacgagatcgtggttgagagaccggaaatgctctttttcttttgtccataattcaattggcttctgattattactttgtgatttctcatgattgagccgttcagctagccgattaacgatatcatttaaatcattgaccgtactaaattctccatcataaggttttaatcgttccattgttcttgctaatgcttcaacgcaacctttggtttgcggtctaaatgggcgacatgcgactggatgaaatccggcatcatggctaaatgataggaatcgctcattaaatcgatgatgatgaaaatcgcttaatttatggtcaatgacagttgacatattatcaaaccagatttctttaggaattccaccagtaaccttaaaggcttcaaacaaacatttaaataaagtatcctgtttctgatctaaggttagttttaggaacttaaatttagaatagggcagaacgtataggaaaatactgaaagtatgtgggacaccatttctatccgtcattgttacccgttctttccaatcaacttgagcacttaatcctatcgtatgttcaactctaatcgttgcttttttagcttgtgtcctacgaaaacggcgacaataatctttaacgatagtgtatttaccggtaaatcctttttcaacaataaaatcatagattgatctagcagaacatcctgcagtgtatttatcttcaatgatatctcgatatccgtctagcttactacgacgcttttgtcgcttcctaacaactgctacttcaccactctgagctcttacatatgccgcttttacggttcgtggatcaacatcatattgccgtgcaatagcggaataatttggtcttatcttctctaacacaaaatatctcatcctttcgtaaacgtcttttcgcatactcatcacttcctcaaaagattgataaagtgagtatacaaaaaatgcaggaaaatcgacaattttaaaccgccgatttcctacattttacttctgacctttacatgaccttactgcaacagaatttcgttacggcaaagccaattaatttttattatttagtgtgtaaacttgacagggtacagtaccacgaactagtcactcagctaatgcatcgtcgcaacaatatcccacgaaaatctcttaattatcgtacaccattagaagtattcttgagtcatgtcacagaagaacaactttcaccttttttctaatttaaattgacatttcaggtctaattatttttacaaagttatcaattacttatccagtgttcttttaaaatattaaacattacataccaaaacaacttcacaccaactgataattaattttctaatcaataagaaaagattctaatagcaaggtatcaacccttttattaacacttttatagctatatatttaccttatcttcttattattttgaattactcttagcttataaatgatagtagcacacaagtaaaaatgatatttgcaaaatactagtggcaacaatctgggtgtaagtacattttttaagctaattacttctaatgcgttacttatataatcttttttacaaagttcctttagctcgaacattgaattatgacttcttacaaaaacatgatgaactatcatcaagttaaattgcatcagcacaaaaaaattaaatgacttttcaaaatttgggaatccatttaaatccttttttacttgtaaaattgctttttcatattcatgaatcatttgtgaattatattttctaactgttgaattttctgacaagatataattgtatatatttttcttaataaaccgtatttttttacatagtaatacgtacctaattaagaattcagaatcttctgaatatgctaatttagcattgaacctaagattctcttttcttatcaaggttgtcttataaaactttccccagacagtcatatacttagtaggattttctagcatttgcttaataattgatatacaattgtttttacattttgtcatagaatataaatcaatttctgacttattaacgagataattgccaataattaaatcttcttcggcatttaccaaaagctctcctaatttactactcaaatttagcaagcaatcatctgcatctaaaaaggtaatccaatttgcactagctatttctatgcctttattccgagcattggaagctcctttttttgattcagcataaatcacactagaattcttttgaacctcttgctttattagcatctcagttttatccgttgacccattatttaccactattacttctatttgatcactcaagtatactcctgtacttctaatagcctgaataatagtcttttcacaattataagcgggaattactacagataatagcatttactcctactcctttcataaacatattacctaaaataaagaggactaaataaaaattacttagccctccttattattttctatttagcttaacaaaaatcctatcactctactatttgccagtaacagaatttgcagtaacatggtaagtatgaccatttccagaaacagtccaattgttagtgccattttgtgtagctgtgtaaccgtcaatcgaatcaatcgatggcaagtcatcggttgactgccctgcaacaccacgatcatttaattggttaccaatatgttccttaacaatatttcgagcatcagtagcagtcatcgttgcctgttggtcattagaactttgctttacgctagacttagcagaactgccattgcttgaagttattgttgaagagacagcatagttagcgctacttgatgacttacttgcattggaaatactgttcttagaagatgcacttttttcattagtttgagaatcttcattactgttacttacagtctctctttcagaactaatcctattcttattagaatgatgcttcttagtaactttacttgaagtaacttcagaactactatcagagctatcagaagaactactattaccacaggcagctaaggttaacattaatgttccggcagctaaagttgtaaatagtttttttaatttcatttaacttctcctcgtttatctatattatcgctattataacaatagattactattaattatatcaaaattacatattgatgtagaaacttggtgtgaagtattttgaataaccaatctttacaacatcacctggctctggtgcgtgaacataagtaccattaccaagagaaatagctacatgatatggagcgccatcactaccaaagaatagtaatgaaccctttggagcattcattacatcacgcttatgagcacctaaagtagcttgctggtaagttgttcgataagctgaacctaaaccataagcccattgaactaacccagagcaatcaaagccagccggagtatttcctccccatacgtaaggaacaccacgttgggataatgcacggttaactttagcatcaacattagacacttgtttggcaataccattagcatctaaatgatatttcacgttattaaccgttacatcttgattaactaccttcttgaaagtagttgggtcaaagtagtaagtctgacctttccaactttgaagccctgaaagaatccgtccgtcattgccaaagagataccagtcaccccattgggattgacggtaatcattatctacacgaaggtaagtacttggatcaaaataatagtatgaaccagcccattgctgtactcccgtttgaatacgaccatcattgccaaagagataccagtcaccccattgggattgacggtaatcattatctacacgaaggtaagtacttggatcaaaataatagtatgaaccggcccattgctgtactcccgtttgaatacgaccatcattgccaaagaggtaccacattccccattgggattgtacataattattgtctacacgttgataattattgttcgcatcaaagtcatagtatgaaccagcccactgttgtactcctgattgaacaacaccgttatcaactaagtaccaactattaccttctccgttgattgttggtaaataagtatagtcacgtcctgatgttacctcaccattttgataatatgtccagtcattgttttcatttacccaaccatttttttgctgggtgtcttgtggctgtactggtgtaactgccggactagcaacatttgtatcaacattagtggtttgttcagcggcatctaccgaattagattgtacagcagaacttgctgcatctgaagtgctagtagcaggagtttcttcagctacttgggtagtttgtacagtagatgttgtagtagtgtttacgtcatctgcatttgctgatgtagctaatccaacgatactagctactgtggcaaatgccataacgcaccattttttaccatctttgtataacttgtaatgtttcttagtatccatatagctaaaaaaatcctttctctataaaaccgttcttaatactttctttaataattatttaacgtttattaagataccagttatttagagttaagacaatcctatccagcgatatgttaagaaacgataatgtttgacacttgaatgtaatacttttgttacactaagcactaaaaaagacacctaattagtcataatgactattaagcgtcttaaaatcgttaattagaattcaccataatataggcttaccaactcataaaaatcacgcattgtataatcagtaccatagaaattgtgggcatttgtgtaccaataaccatccggatctgtatgatcagtaccacctaaatattgagatacattatgatgagaccatagagttccgttaccattagatactaacgaaggcgcaaacccatacttgtgcataatatatgcagtgtagtaagcagcgttagaaagttcccgagcaaacgcatctgcattatgtacctcaacttgttcaaattgaacggcccgaccattagcaggataacctgcaccccaagcctcatggtcagtatttgagatctgaattatattgttattatctacaaaggcatgaacgaatgcatcattataatgattcttttcgtaatttatttcaccccaaatactatcattaggattagcagtttcatggacgataactatatttggtaatccattacccgtaccactatattttccagtaatattcaaaggaatggcctgcccattatcataaaatgtaatattagcatgaccaagattattattaagaatatagttgttaattgaattcaatccagaagtaataattccactgccacttgcccaataacttttaccattcgctgaaacccactggttagttgccttggtatataagtaaggagtaaagtaatacaaactttccttccagccataaagtcctgaaacaattcgaccatctggaccaaacatataccaatccccccattgggattgacggtaatcattgtctactcgaaggtaagtacttggatcaaagtaataataagtatcataccatttttggactccggtttgaatacgaccatcattgccaaagagataccagtcaccccattgggattgacggtaatcattatccacgcgaaggtaagtacttggatcaaaataatagtacgtactagcccattgataaactttggtagcaattctaccatctttaccaaacatataccaatcgccccattgggattgacggtagtcattatccacgcgaaggtaagtgcttggatcaaaatagtaataggtatcggcccatttttgaacacctgtctgaattacaccattatccgttaagtaccagttgcttccgctgcctttaccattacttgtaattgttggtaaatatgaataagtacgacctaaatcagttttaccatttttataaaaagtccagccattagattcttgtacccaaccatcttttactggtgttgatatctctgttgactttggtgttactgagtttgctttttgatccgtggcttgttgagtactaatatttccctgttgattattttgattagactgattagtctcactttcgccaattttagcatcggttgattctatttgagtagcatcagatgctgaactctgtgctaaactcgtttctgcctgtgctgtatcaactgttgtatcagcactagcaaccccagttaaactaactgttaatgctagtgcagtaattgccatgacacaccaatttttccccgacttatataatttataatgctttttattagtcacttttaaactcctcttaaaatttaaattacgacattacaggtacatattctaacaggtaatttctcagattcaaggtttcacaataataaggtttctacaatatctggtgttgatatagaaatattactttctataccaatatcagattttttgttatttaaaacagcctaaatttagtaatcataaccacccgtcaaacgggtggtttgcacatcggctataagccgataataaaagccggcgtctcaaggcgctggctttcgctttgctcaagccaaaatgctctgactactttgccaccgctttaagcggtgtttatactacctcacttacccttaaaagggtccgaatattccacacttgttagcttatccattgctatatcatgtttctcttgatctcggatatacttctttatcgtggattcatttaatccaactgtactcacatagtagccttcagcccaaaaatgtcggttcccatatttgtattttaagtttgcatgtcgatcaaacatcattaatgcacttttcccttttaagtatcccataaactgcgagacacttagtttcggcggaatacttactaacaagtgcacatgatctggcatcatatgaccttcaattatttctactcccttatatttgcacaacaaacgaatataatctctcaggtctcttcggtattgattgaagatcgctttacgtctatactttggtatgaatacgatgtgatacttacataaccacttcgtatgggctaagctatttaatttattagccatatttatataacctcttttcccttattgactttggcttgaacacctacatcttaaggcaaaagaggccttttttatataatttttatcgcccacccgcatagcaggtgattttttgtttcgtgcactcgctctgctcgcgcactcaactaggtctaaagacattaataaaaaaagagaatcatgatgattctctttaagtgatatatacctaaaatacttctttgtcccaagcctctaaattatatgttcgaataacattatttaaactagaagcatatttaggatctgttgcataaccatcagcatgtaaataatttgtaacagtagcatagtctttcttccacaaaagattgctgtatcgtttattagtagcaaggaaacgcccgtggtcaactacactctcataattacttggatatttccgaaatgcatcattaatgtaataataaccaccagtaccatattcagcagttctcataacaattgactgaccattatagctacctttaataccaaacaaattatgtccttgtgtagcaagagcagattgaccccaagcactttcaagaatagcttgagctgcagttacagatggcaatacaccgaattgtcgccagccatctaaagccgcatcatggatacttaataggaaattagtattccgattaattcctgaaataatccctgtactatcggcatgaaggtttagtccagctaccgtaatatttttattagttacctttaaatatgtacttggatcaaaatagtaatagctaccagcccacttttgaaggccagatagtacacgcccatcaccaccgaagagataccaatcaccccattgagattgacgataatcattatctactcgtaagtaagtattgggatcaaagtaataataactaccggcccattgatatactttagtggcaatccgtccatcattaccaaacatataccataacccccattgagattgacggtagtcgttatctactcgtaaatacgtacttggatcaaaataatagtagctaccagcccacttttggacaccggtttgaatttgcccatcattgccaaatagataccacatcccccattgtgactgtacatagttattatctactcgtaagtaagtatttggatcaaaatcatagtatgtgccagcccacttttggacaccagattggacaacaccattatcaactaaataccagttattaccagtaccattaatagtaggaagatatgaataattgcgaccagatgttacatcaccattttcataatatgtccactgattattttccttaatccaaccatttttcacctgtgctgcttgtggttggattggtgtaaattgactaatatcctcatcagtctgtgtgttatcacttgttacatttacatgtacattatttgaattttcattagcattatttgaagctacttcatcactacttttaggcgtagcagtaactagctggacttcattattagtcgtaatgttgttggtggtaacttctgtttgtactgcattattaactgattcttcactagaattattcgcatttgtatcagcatttgcagtagtgaacattaccattgtacttgccaatgttgcaatcgccattacacaccactgtttaccgcttttatatagtttatagtgcttacgcaaattcataatatattaaaattctccttaataatttaactatttaacatcatataacaatttaacatggtttagcgatatgttaacaaattgtaatgatacttaaatttaatgtaatatttaaggaattatcatcctaacaaatttattcttttttaaaagaacgattactatcgaaagaacaatatatgaaactattggaactaaaaatatttcatatgggttattcattaactgaacaaattcaggccaattatctggagtaacatgaaaaacatacttataaattgcctcataaaagattggatggatgatataaattcctaagcttactccagacaatattccaaataatttaaattgataactcttatatttatacaaaaactcaacaatccgtttaaccaaaagataaagtgcaatagaatacagaaaatttccaatattatttaacatatgaaccttctttaaggttaagtcattaattattgaaagcattaacgtaaccatgccaataacaattagccaattttctcccttacgattaaaaaagttctcttttattagataaccaataataaagaaaccaagaaaatccgaagtaagcaatggttgagttaagtaatcattatttattttcaagcctgttaatttacttatataagtaaaacaatctataaaaataaaatttgcaattacaattgcaaataaagtttttttatgttcatcaactaatactgaaaaaattggagccactaaatagagagcaataattgtataaaaaaaccaaaataaattattaatgttattactagcaaacgaattaataaaatccgtgatactaggattaggatgcaacgatggaccaggataagcacgatgtttaatatcatatagatagtatattatcgaccatacaaagaaaggaataaccactcttttgaatctttttattaaaaaagttttagtagaatacttttttcgataatctaataaagtagctcctgaattcataaaaaaaatatatactgctggaatgcataaagattgtagtactaaagcagttatatagtttgaataatttgtatttcctgaaaacgccaattgtgatgaatgcagcaccaagacaaaaaatattgcaatacaatttaatacatctatgtagtggagtctcttactattaagcataattttccctcctacactaatcccttttctaaatttgaaattgcagttttaatatagaaccctgaccgtagtttttcagcaacttctttggcgttgttcaccagttcactataatcaatcgaagatacattaggtaacacttcatctaattcattcaaactatcaactacaattccgatgttcattttttcaacaagatctgctatcgctgcctgacgccaaacaactacaggaatccctgagcttaaatataaagaagctttatgaggattattaaacttcatataatttccaaataagccatcgcaagttattggtgtcgttccatcccaaaccaatccaaaatttccttttagataattaggtagttcatcggggggatactgacccttgtatactatgttagctccgtacttttccaatggattaggaccaaagacatttaatttcaccctttttaaggataacttttctaaaaagccagccttacttaaatttccggcaaagcaaacagaagtctcatagtttgaaccagatgctagcttaattttattatcataatcaaataagcccaagctttccattgggactgttacaccattatctctaagccacttttccatttttgcgttatgaacaattaagccatcagccatattaaatactcgaagttcctcatcaatgtaccctttttcgccataatggagtcgcaaagattcaatatcgtgaataatcaaaataattttagaattcatttgttgaagtctttttaccaattgctttgtaacaattttagaatatgttggatattgtaaaaagatttcatcaatgtcattttgctttgccaaaaagcgtggaacatcaatatatgcaacctttgctttttgcaaaaccgattcttgattaattgtaaagttccatttttcaaagccatcttttaataagaaattttcaatatcaatttttgctttgggtcctgcattgttatcatggtgtgtttcttttactgtcaatattacttttgtcatacttatccacccaactaatagtctgtaattttctttagaacattacgcaagttctcaaaataccgttcttcataaaactttgaaatactattttgaatcgctactttgttatattcagtttgtgacattttattaatctttttcgcacattcttttatatttccacgatgataaacttccccatttatgccatccacaactacatccgtaaaaccgtcaaagtcagcagaaagacatggaattcctctggacattgcttccaaaaataccattggtagcccttcaaagtgcgatgtcaaaattaatgcaaacggttgatatgctaatgaactccatatattttcagtccagccatgccacttaactctatctttaatttctagtttttcagcaagttctttacactgactctcatcttctccgccaccataaacatccaatacaacagatgaattagtcaagctaacggcacgaagtaactcttctaaattcttttggcctgttaattggacccggccaacatataataaatgctttttactactattctcttgaatatctaataattgatgatgttctgcaggattataaattaaaaaaattctttgagaagcaattcctaaatcaatcatctgttgttttatcggagaactaattgctaaatgataatccgcaaacacaatattatgtggatcataatccatctgattagctattgaaaaatgaaaccatgaaattaacttacaatttttatgagttacttttcttaacttagcaaataacttaataatgttaggactaagaattatataattagtatctttaggactcattaaaaaaatctttataaagtaagctaagcgatttagtcgactactattctttggataaattacttttatactaggatttaatttatgcagccattctttatctggcgtcatattcgataaaactaatcggatgtcattaccattttcaactaaattatttagtactttaactaaaactgtttctgtcccaccacgaccagttattttattggttataaacgttaacttcataattaagctctctttactatttttttattaaagccttggcttgctttaagattggtgcttttagcatgaataaacagattacatacacaaaaattcctaatgcaacttgaagtgctaaattaataatcgtcatactcatgattaggtttattcgagaaacaataatgtacataaaaagtccactcagtagataccgccatataggagcaaaaagtgcccgacgtcgaattgttcctttaatataaaatagctgaactgctgtcactgcaaactccgaaataactgttgcaattgccgcaccattagctccatacaaagaaatcaagaatatattggcaactatattaactactgctccaattgttactgaaattgtatattcatgttcatgatgaattggcattagatactgggtaccagtaacattactccatgcaatcatcagaatggctggagcttcccaaaagataacaccaccagtcgggccatattcactacctaaaaaccatggagcaaacttataggcaatcgccatcagtccaaacatcattggagttgaaatagctgttacaaagtcaaatgatttatacaggctctcacggactccttttacatcaccagaagcaaacttatttgcaatatgtggcaacataaccgtcccagttgcagtaacaaccgccaatactagttttacaatgttatctccaaaattaaattgcgaaactgcagcttgcggagccattctccctaacataatccgattcacaactaaataaatttgtgttgtaatcgtgggaataaataataacaatgctggataaaaatgtttaagtgggtgccattcacgaatgcttacccactgaatattatttttgagatatggccatagggtaaaacttccagctaattgggcaaaacctaataagaaaatatatttagcaaggtcactttgattacgcactaatacaaaaatcaaggcaattgttatcagtttgacgattgtgtttcgcgaaacagtctttttaaaatcctccatccccataaaataccaagaaatatcaattccataagcaattatccataatgcttgtagtaaaaaataagtcttaaatgcactactaaataaaaatactgctaataaataagtaattaaaactattgaactagtagctacttgaagtgaaattattccccaaaaagtttttgatcttttaaatttatcgtttcgttggtaagctatttccctattaccatatagagaaatgccaagttgacctgctaaatagaaaaatgttacccatccatttgtatatgtattgattccattattattggcaccaagaactcgagatacataaggagttgtaattacaggagctagcattaacaatatttgatagcctgcattatacaaataatttttgataaccttcatgtaacaacctcatttgacttttcttaaactaaagttttattttaccactgtattttaccaaacaaaagacagccatgttacactttagtttctgataaaatgtgctacttactttgatatattattttatagttaaactagtatctaaataagtagcttatactaatgttaaagtacaagctacttatcaaaatgcttcattctattttttagcttttaaataaacccacgtagtagccgagaaagataggataaaacctaataaaaatccaacagctgctcctaataaagtaagctttttaattgacggagaactatcacttttggcttcatcagccacagccttagagaatagggaaattttatttgctgaggttactctttgaggaatctttttagctgctgcctcagcaacggcatttacaacagccgcagaatcgtgtgcagtattagccttcgcacttactctaacaattgtagtttgcattatcggttctgcatttaccattgatgagatttgttctgcattgtatttctttcgtaagtcttttgataaatacttacgagcagcagcagcagtatcattactttctattatttttgcatatgtatttccgagattcatatcagcttgaagttcttcatttgcattagcaccatcatatgctctactagtcataatatttctaacggattcataggttgtatgctgtttatgctttgcatataaattgccccctaatccaaatattattgttgtaataaggataatgaatacgtttttccaaacaacttttgaaatattctttacgttgaaatttttctcactcatttatgcttctcctcctgagtattataaaaattaggtatagcgaataatgctaatagaaatgggttgtaaataatcttaattatatctggttcaaacataaaatttaatgctgcaactaaaataattgccgttaaaataaatgtttgccgaaatgttgatcttatcgcaatgtaggtcatgcacccaattataagtacaaacgataatattccccataataaaatcatccgaacatatgaggaatctataaagaagtaatggctcacaccatctatttgattagctaatttcagccctttacttccaccatatgtatgctctacgattgtctgacctaaaagcttaacatcgtaattactaaaagcttgatatcccaagctcaatctaccagaagtaatatcattgatttttctcattatatgattagatgcatcatagaaataagaagtaaaaattattatagaagctgaaattggtactgccatccaccaaaaagaggctagtatctccgataatttatggcctctaaatgctcgctgtgcaataatcattacaggtattacaatcatagtagctataaagtctaacttagtatttgtaatcatcataaaaataacatcaccaacaaagataaaaagataatcaaaccatcttaatttattaaatctaagataacaatacgctaataccaaatagaaatagtgagttgcaaggcttgatgtataaattaaacctaacgaatatctcggtggtctgggtgcagcacgatatattaaattcggtattacccctaatagtgagaaaattgccattgccagcaacaacattacgtttaaatatagataccaagttataatatccttaaaattaacattttttgctccaataacaaaaggcactattgttaatagctgtaattcatgcgccattcgccaatttatcatgcctaatagtattaatatagtaattataactaattcttttttactccacctatccagaacgtatattttaaataaaagtaatggaagtgcgagatacgaacataatcttaaaaaacggccatttaatgcttccgctagagttgtgtcttgaataaatgaagacacaaaaaaaatcacaaaagcaataaaaaatatctgactaccgttaataggaaaattgtagatattttgagtatttcttttaagcaatttattatttcccttcttgaatgtaataaagctatatctatgtattttattacattgcagtattaaatccttaccagactaggaatattgcatgataccggtaatagaacgtttaataaacgttgcgtaattcactaaaaatggcaattctaccaatcttctacggattaaaattatttaatatcagttaataaaagatacaattcttataaatgctctagctaaattccttattaacagctgtcaatgctgcatgtaatacttgatccatgttgtaataacggtattgtcctaagcgaccaccaaaaataacattatcagccttttcgtcagctaacttggtatattgcttgtaaagatcgttattccgttgattgttaatcggatagtatggttcatcaccacggtgccagtcagcagggtattcacgagtgatgatcgttttatccttgtcacccttaccgaactcaaagtgtttatgttcaataatccgtgtgtatggtgtttcagcatcggtatagttaattaccgcattaccttgatagttaccaacattcttttcttcagtctcaaaacgtaaacttcggtactgtaactcacctaattgataatcaaagaacagatcaatcataccggtaaatactattttcggataatcttcaaggtacttagccttttgattaaagaagtcaacaccagtctcaacatcaattaagtcgctatcaagcatcttctcaacgatctgggtgtaaccaccaattggaattccttggtaggtgtcattaaagtagttattgtcatataccaaacgcactgggagacgccgaataataaaagcaggtaattccgttgctttttgtccccactgtttttcagtatagcctttgatcaacttttcatagatatcgcgaccaataagtgaaatagcttgttcttcaaggttctttggttctttaccagccatttcttgccgttgctcattaatcttcgccattgcttcttcaggtgtacgaactccccacatctcactgaatgtattcatattaaatgggaggttatacatttcgcccttgtaattagctactgggctattcgtataccgattgaattctgcaaactggtttacataatcccacacttccttattagacgtatggaaaatatgggccccatattgatgcacttgaatgccatctacctccttagtgtagatattaccagcaatatggtctcgcttttcaatcactttcacacgcttaccacgtttagcagcttcataggcaaaagttgccccaaaaaggcccgcgcctactactaaataatcatatttttgcataactatctccttattaactaactttctaatatgcaccctcactcttaaagatactaataatattcttaaacattatcttcatatcaaatccgagtgaagcctcatcaacatattccaattcaacatcacaacgttcgggataaggaatattactgcgaccacttgattgccatagtcccattgctcctggctttactgacaaaaacttatcaactcggtcaccatactcagccaactctgccttaacaactggtcggggcccaataatactcatatcgccacgcaagatattgataaactgtggaatttcatcaattgatgtcttgcgcagccattctcccaaacgcgtaattcgggggtcttcttctggttctaacttatagttatttgccacatatttagcataaagttcaggatcattttccaaaattttatctgcattctcaaccatagaccggaatttgtagattttaaatggcttcccatgccagccgatccgttcctgcttataaaacagtggtcccttattatcaccaaaacggttcattataaaaacagctaaaaacactgggctaaagcaaactaatgctcctgatgatagcacaacatcaaagaacctcttccagaaaaggtagctcttagattgttgtttaatttttaccttctcactcatgattctcaaccctactttttctctttaataatatatatcggtcgtttctttgtctgcatatatatccgaccaatgtagcgacctactattccgaggcaaagtaactggataccgccgaggaataaaataatacaaaccattgacgcccagccaaaagcactactagcaggctcaataatctttcttattataacaataatcatcccgataatggagatgaatgccgttaatccaccagcccaggtcgcaattgccaagggagcttcagaaaaatcagtaatcccgtcaatcgcatacttaaataacttccaggtcgaccaatctgttgtcccagcaactcgttcaacatttttatagggaagatacttagttttaaaaccaacccagttaaaaataccttttgagaaccggttatattcagttaacgataacactgcatccaccatctggcgcgtcatcatccggtagtcccgggctccagagacaattttagtatcagaaatcttattgataacattatagaattggttagaaaggaaagacttaaacttcgcctcaccctttcgatctgtccgccgcatccccacacaatcatattcaccagtggaaatagccttatacatctctggtaaatattctggtggatcctgtaaatcagcgtccatcacaacgacataatcacccgttgcggcctgtaatcccgcgtaaagccctgcttctttaccaaaattccgtgaaaaagaaacataatgaacctgttctggatcctgttcatgaagcttccgtagttctgctaaagtcccatcacttgatccatcattgacaaaccaatactcagtgtccactggcatctgcttaaccactttttcaactgccgggtaaaaaagcggaatagtttcttcctcattataacaaggaacaactattgacaattttggcattcttgtctctccaatcgttaatgctcaccatgaccggtaactttacgttttaagaacttcacaatctttaatggccagttttgcttttcaagaaatacccggttaacttccactgtcttgtattgcggattagtcaacaaccaagtatctagtaaaagctcacttaaaaagccaaagacccgttgctcatatggtgtatagtcagaataatcaacttttttatcaacttcgcctaaaacatcaaacagccaggtacaatattcatccaacggctgcttcttcataatcatcatgttgaaataatgagccgatgtctgtttcattactttttcaaaagcgggtaagtactgaggatatttctcctttaacacctgccgcgtaatttcaagcggctcgtgctcatgaacatggaggtaatgtgattcatttgtttcaatgtagtaatgccgcttctttggcaagattacatcggcatctgtcaataactcttcaacctgttcatgattgaggatggtcgaaagatcctttgagtgccccatcgttaagtaacgacggtagtggactaatcctaacgcatccacatcaagatttttccatccccagtacagagctgttaactcattgtagtgcggattcttttttgaaatattatctccggtgttatcaccctgaaatgtacgattaacagtcgggtgaatctctttaccaacaaaaactggtaaatacattggatcatctggcatccgataatttttatggacagccactaagattttaatattcactattgtactcctaattattgtttttaaacataatcattaaaataataccagtaattcccaatcttggaaagttattattggaaatcctgcgcatctaaccagctttggacatcatcaagatcaaagcctttccgatacatcgcctgcttaaaatgctgctcacgctcgtatccttgataacaacgaacacgacgccattgctttgctgcttcttttgctaaaaggtcgttctcttgctccagatcaggttgtggaacaacttcatccttaatcatttcatacacactactagagaagccttttgtcatgagtccttgttgtactttttgttctcgtcgccgctctggctggtttcgataacggcgaaataacttttcagctaacttttttgccaattctgcttgaacttcgggagtaaattgcgttaaagcatcatcaatatcgttttcgccaatccctttttgtcgtaagtgttgacgaattaccccaggtcccttcaagtccgtattaatcatcgtgcggacataagaagccgcataggcatgatcatcaattaactgttgcccgcgcagcttttttaagattgactcaacaaactcttctggcgtgtcaatttcttttagcttcttaacgatgtcgctttccgtccgcatctggtaagaaaggtagtcaagcattcgtgaataagccttcgcttgctggtcagcagtcgcaatggccgcaatttgcttttcatctagctcggttcccttcatcaaacggaactgaatcaaaacactttctgcaaccggaaaagcatacttaccatcaaggtatatattatatcgacccttccgtttttgcgcctcaattttcgaaatttttgccatttttaaatttctccttaacactctcaatttttaatcgtttataaaggtgtaagcagtggccactacttaacaaatcaaattaaacaaaggaagtttttatcatgcaaatggttcgtaatttcaagtccgctaaaattcagcttaccctcactaacagtgaacatcccaagggcgttaaacatccctttaacaacattattgaggatgtcactaatgagcaggtagcacaatttagtgcggcaattgaaatgcttactgctgaaaaatgccttgatacagatattatcgttactagtcaagttgcaatgaacaactaatctcaaggaggaaattaacttatgcgtacattaagcttaactttcaaaggtagtcttggtaaaaagcattcattaaagttgaactatgccagtggtgatcttgatgccgaaaccgttcggaaggcaatgcaagagattgcacaaacccacctcttcactaaggaaggcgaagatatttatcagcaacctctttctgcgaaatacgttgatactgtttctaccgttatctttaacgatgaacaaaagtaattaaatatcaagttctaaagatcttcaacatttggaggctaggaaatttcctagcctccatttttgttttttctttctaccagttgccaaaagtgtttcttggcatgcaattcaccttcatgacattcttgcaaagcagcatttagcgccgcccccagcatgataatatagccagaaaagtcaagccataccatcattgcaataaaagctccaattgtcttgtaggaaattaccccgtgaccaaataataaggtatagaacgagaataaacgtgataatcccatccaaagcaatgaagccaagaatgaaccagcaagtgcatagcgcaaccggaccttcgcattaggaacaaagtaatacaagagtgtaagagcaataaacaagacgccaaatgttaccggccaccttaatgagctaaagatagcaatgtaatcacgccggaaattaaaaattggctgaatactcttaagaacctgctccccaaaaccgtataaaataatgatgataaagataattactaagaggacaatcatccaaacaaatgagacgattcggttcatcaccggattctgattttccgcaatcccataggcatggttaacgctgcgttgaaaagcggcaattccctgactggtcgaccagagagcaatcaaggccccggttgtcagaacaccaccactcccccgtcgtaagaaatcatagatcaacggctggataaaatcatagaccgattcaggaattgcagttgagaggtaggctaaaatcgtcttagcgtcaattccaatcatcggcaataaatttcctactaccatcacggcaggaaaaatagatagcaaggtatagtaagctagaacagcagcagaacttgaaatctgggccattgtaatatgttgaattaataacgcaataaaagtcttgcccttgcccgattccttgtccataataacctccgaaaatattttataggtttaattataacaaactgcacacaggacaaatattacattaaagtaaaaaagaaacggacataagcagattccttgtccataataacctccgaaaatattttataggtttaattataacaaactgcacacaggacaaatattacattaaagtaaaaaagaaacggacataagcagattcctttcataaaaaacagataatacagtataacaataagcctccagcgctggtaaaaccaaatgctggaggcttattgttgcttacaggaactcgaaaacaaagtcacacgcttccttttcacttcccttattcagcaatattatgacgctttgcggagatttgatagaaaaccaatgcaacgattgcaaagaagattggtcccgcaagtgtccagaaagctgtttgataatctttttgtaatagtggttgaacaaacgtaaagacgattccgacaattaaaatcaattcaacgaaacatactaatacatctgtccagaaacggttcttaaagacaacgaatggccggtcaaggttcttcttcgccttaaagaatgggaaagccccgatcaagaaaatatatgggaaacaagttgaaacgttcgccatatcagtcaaaatcaagtagaactgttgagcagcattgccaccaaaggcaaccaagaaaacaataattgaaacaataattgcttgaagccacattgcattcgcaggcatccccgccttattaagtttcgtaagcttctttggccataagtctggattagatccaagaatgaaggccttgattggggagtaaagcaggataaacaatgcacccaagaaaccaagagtctgtgcaaaggcaacgatccgcgtcataataagtccaaaagtaagggcagcaccgtgcgaccatccaagtgcatcccccatggtaacccctaattgattaaagacaacataggtaacattaccaaggttaacgctgctcttagtcaaagtttgttgataatttactgaccaaccaagcataaaaatcattaaaacataagtaccaatcgtaaagatacttgcaatgatcaatccacgagggaaagtcttttcaggatttttcatactatcagtaacggaccctaatgattccatcccaccgtaagcaaaaatagcataaacaacaaatgaaataatagcaattggtgtctggaattgtggattaggcgatgtaatgaaagttgaagccccatgaattgattgctttaagattcccttatcggcgactaaaacaataacgctgacaataacaaagataatgttaacaacaattgtaaaaataccaccaagtgaaccaactttagcaatggcggtcattccccgtgaactacaccaagttgtcccaagaatcaatagaattccaaggaccccaatcaattgagtcgaggtcagaccaaatgcgtgccattgttgggtagtatccttaccaaaaagcaaggcagaaaaagtaatccaaatccgtgatgccgttgataccatccatacaatccaagatgctaaccatacgaaagtaccgacaaaagcgactcgttcaccaactgagccggcaagccaggaataaattccccctttagcatccttaaatgtggaaccgtactctgccatcatcaagccacaaggaaagaagaaacaaatccctgctaatgcgtaccaaataatactaccgtaacccatttgtaagtaggcgtttgaaacattcccaaaaccaaaaatggcggtaatgatcatcgtcactagtccaaaggtagtaatcatctttttattactactctgttcgtccaaaataatgcctccaaagctttagaattcttaaataaaaataagaaattatttaataattattagtatagtcgtcttttaaaaaaataaaagtcttttacagaatttcacattacttttatactatttttcgtatttttataccaacttagtaatctttattcgtttgtttgtatattttggtataagtgatgtatactattttcattacttaataattgttttcacatttaatcttaatgctatggatagcgttttccgacgttgctataattgagttaagaaaatttatgtgattttcactctaagatataagatcgtgaggtggagtaaatgagtgagaaaaaaggtattaatactacagaactaacccttttaattgtggggtcgacaattggttcaggagtatttggcattaccagtgatttagctactgcggcggctcctggtccagcaatcattgcctggattatagtagggatcggcgtcttgactttagtcctctccctaactaatctttcgcaaaaacggccagaccttgattcaggaattttcagttatgcggcggctgcttttggtccgctgggcgaatttatttctggttgggcatattggctttccgcctggctcggtaatattgcttttgcgacgattatgatgagcgctcttggaacgtttttcccaagcttatttgctaatggtcaaaacttattctcaattattgttgcaattattttaacctgggttttgacattcttagtaaatcgagggatcgaatcagcggcctttattaattcgattgggacgatctgcaagattattccattagtcgtctttgttatctgtgtgattcttagttttaaggctaagatctttactgctgatttctggggcaatgtaacacagaaccttagttcaaaaatcgaaaccggttcaatctatgaccaagtaaaggcctcaattatggtaatgatgtggctatttgtcggtgttgaaggggcctctgtcctttctagtcgtgccaaaacgcggacagatgctgaacgtgcttctatcttcggcttagtaagtttgcttgttatctacatcgtggtttccattttgccatacggggtcatgacccgggcccagttagcagctggtggtcaaccggcgctcggtgctatcatgcaacacctggttggaacgtggggtgccgccctgatcagcattggattaatcgtctcagttttagtttcatggctctcgtggacaatgctcccagccgaatcattaatgctaatggctgatgatgaaacccttccaacatcatggggcaagctaaatgaaaaaaaagcgccaacacgggcattagtaattactgggattcttcaatcgatcttcctcttctctttgcttttcactacctatgcctacaactttgcatatacgctttgtacggctgcgattttgatctgttacctccttgttggtatttaccaaatgatgtacagttggcagcaccaagaatggggacaatttgttattggactaattgccaccctctttgaactgatggcgatggttctctctggctggaaagaaataatggttgtttcagtcggttttattcccggattattcttctatgtccaagcatgcaaggaattccatcacccaatcacagtaaaggaaaaatgggcaatggggattatcgctgtctttgcggttatttccttagtattagtaatcaacggaacaatttcaattaattaaaggaggaaaaagattatggtagaaatagcacattttggtgtcgaagcatggctaaataagtgggaaaagagcgcaacttatgatatttcgcagagtacaatcgcttctttgagtatgcacgatctcttaaatttagatggtaacaatggcaaagagttttatgagatgcttgataagcagcaaatgaactacggatggattgaaggatcacctgagtttaaagaagaagttgctaaactgtatcaccatgttgatccagaaaatatcttgcaaacaaatggcgccactggggcaaacattttagccctctatgccctaattaatcccggcgaccatgtaattgccgaatatccttcttaccaacaactctacgatattcctaaatcattaggtgcagatgttgattactggcatattcatgaagaagacgattggtacccacgaattgatgacctaaaagcgatggttaaacctaatactaaaatgatttgtctaaacaacgcgaataatccaacgggaacagttctggataaagaatttctcgaacaagttgttgaaattgctaagtcagtcgatgcctatgttcttgttgatgaagtctacctgcccctcgatcaccccgaaaagtttgcccagattattgacctttatgataagggaatctctactaattctctttcaaagacttattcggtgccaggggctcggatcggttggaccgcgactaacgctgaagttgccgatgtcttccgtaaattccgtgattacaccatgatctgtggaggagtctttaacgaccagctagctacctatgtcttacgtcaccgtgatcaggttctcgcccggaaccggaagttagttcttgggaacctcgctgtttataaggattggattgaccatgaagaccgagcaagtgttatcatgccacaagcagtctccacttccttcccaaagcttgatgtgccggttgatatccatactttctgtgaaaacttgcttcatgacgaaggagttctcctcgtgcccggcgatgcttttgatactccgggtcacgttcgcctcggctactgtgcaccagaggcaaccctaaaagaaggcttaaagcggctttcaaagtatatgcatcaatatgattagcgttaaaaaaaggatgtttgaaacatgcaaaagttttctaacatcctttttactgctagcgattaattttcaaactgcttagcaaccttttctgcgatctcacggtaatgttccaagtacttagcataattatcatcgtacatgtaatcagcatctgcttctggatcttgagatgtcaaaatcttcggaccatcattcgtaataactaaggtatgctcatattggcaactccaaccaccatcagcagtcttggcaagccaaccacttggatcactggtatcagcttcccacgtaccggtgttaatcattggttcaacagtaatggtcatcccattacgaagacggattccttgaccgtgttcgccatagtgaggcaccattggatcttcatgcattgttggctgaataccatgaccaacaaattcacggacatccccatagccattctcatcttctgtgtagtgttgaataactgccccaatatcaccaatccggttaccaggaacacattggtcaattcccataaacagtgacttcttagtaacatccattaacttttggatttcaggagaaacttctcctaccgcatagctccagcaagaatcactgaaagcaccgtcaacactgacaaccgtatcaacctttactaaatcgcccttctttaagattaacttcttacgagggaatccgtgacaaatttcatcattcacactaacacaggtagcatacttgtatccttcaaagccaatttgttcagctttagctccagcagccttgaagtacttccgagcgaattcttcaatcttccaacttgagatgcccggcttaataattttacgaaggccaaggtgcattgccgctaaggctgccccggccttttccattgcatcgatttctcgaggtgattttaaactaatcattttcgcgatctccttatttacaatctaacataaatagtataccacttgtctgccctgatatcgcaaaccgtgctatactatatgaacgttatagatttaatggaggttataaaatggcaaaagcacttgtagtatacgcaaccattaccggtaataatgaagacgttgcggatatcattactgacgctcttgaagatttaggagtagaagtcgatgaagttgaaatgacaatggctgatccagctgactttgaagaagctgatatttgtgtgatctgtccttatacttacgatgagggagctcttccagaagaaggaattgacttttatgaagacttgcaagaagaacaactagcaggcaaagtttatggagttgccggctctggtgatactttctatggggatgacttctgtgttgccgttgataaatttggggatgctcttgccaggacaggggcaactaagggcgctgaaaatgttaaaatcaacctcgcaccagatgaagaagacattcaaaagctcgatgccttcgctaagcaattagtagaaaaggcggctaaactgaatgattaaggatctgtgggtaaaatataagtcaatcatcgcctaccttttttggggcgttgtcacaacggtggttaacttagcagtattccagattttgagttctgggattcattggaattatcaagtagctaatgttattgcctggtttctatcggttttagtagcttacttcactaataaagtctgggtattcggatcacattacactactgttagtgactttattgttgagtttcttcggttctatttctaccgaggcctcacacttgtattagatataattattatgtatgttggggtttctttattaggattcaatgatcctctccaacaatttatcgttaaatttattgataatgtcattgtggtaattgctaattatattttctcaaagtggttaatcttcaaagataatcgcgatattgcagataaataaatgataggattcggactgtaaacttacagtgcgaattttttatttattttgagaatcccaactataataaatattaagaagggactgacctaaaatgatgaaaaaattcccaccaattgaaaaaatactagaagcttatacagcaattgctgacggtcacgttaaacttgaaaacgatcaagcactcataacctcctctaatgaagcgaaaacttataccgtcacctttcacgacaatacctatacttcaaatgacaatgcctcatactggcaaggctatcttggatatcccggaattgctgtcctaatgcttcaaggaaagttaccatataataaggaattagctcaacaatttgccggggttgattggaataaaatcaatcaagaatataagcgtaattatgcgtaagctgctgatgctgttatgactgctaaaggaattgataagaagaaagcagagacggaacttcatcatgtttacgatgccctaaagcaattaccaattaccaattatcgttaaacgtggagcattacgaccacctaaagcaaactaaaggtgaataagagactactcttttacataaaaagctctcttattcaccttttttattgttgtgataagtatttttcaacaattttaagaatcttttcgcttgcgtgcccatctccaaatggtacttccgctagttccatttgccgatacttcttctcatcatttaacaattcaaaaaccgcttgttgaatcgttgtcggatcagtaccaacaatttttacgccccctaggctgaccgcttcttgacgttctgtttcatcacgtaaaagcaaaagagggcgatgcaatgctggagcttcttcctgcaaaccgcctgaatcagttaacagaatcgaactccgggcagcaatatttaagaaatcatgatgatttaatggtgtaataagatgaatccggtcatgatctcctaaaatatcattagccagtgattcttcttctggatgaggatagacaggaaatatcaggtcaagattgttgttagtttccacaatatcacgcattgtatggaaaacacgcttcatgggggcgccaaggttatctttgcgccgcattgtcattaataaaatccgattatctgctgggatggactgcagtaaaggatgcgtaaaatcttcttgtaaattatgcttcacgctatcaattgaagtatttccagtaacatagattcgttttgctggatggtgctcttgcaacaaattatcgcgggcacttgtcgttggcgcaaaataaaggtctgctagattatctgtaaggcgccgatgcatttcatcagggaatggtgaataccgttcataagtacgcaaaccagcttcgacatggccgagtgaaatatgatgataaaagctaattaaactggcagccaaacttgtagtagcatcaccagcgacaaggatcatatctggttgtccagcattaatcacattatttaagttatgcaacagttggctcaatagttcaacttcatttgtgcttgttacgttcgatgaatcaacactgaaatcaatttgaaaatccagatatgccaacgtgtcgtttaataattgggaatttcccgttgcaacaagaactggttgccaggttgctggattttgttgcatcaatctaatgatcggcgccagcttcaaaacctcagcccgtgtaccaaacaaaaacataatcttatatggtgactgcattaatgattctcccttcagcttctaataaaaaagacgtaatcactaaacaaagcaatcacgtcgacagcgcattatcaaatggtcccatccggatttgaaccggaatcgaccgcttaggaggcggatgtactatccaattatactataggaccaaactaaagaatattatcgcatttacgaaggatttcgtaaagacgataattattcttttttaattttcgttgtttttacgccgatgtttcaaacgaattcctttatttttacgattctttttctttcgccgtttcttgggcttagagaatccactgagggtttgattcatctttttgtgggtttcaccacttaattgttctttttgtaagtgacgactagcctgctttttaattggaaccacccgttgaccttcttccggtttctgattggttaatttattatcaccaatgtagagcttagttagttcataatcactgtcagcaagcaacttcttaaggtcacgaatgtcatgatcatcacctaaactaagtgccagtcctggttctccttggcgtccggtacggccaacccggtgaatgtaggtattaagcgatgttggcaagtcaaagttaataacgacaggcaatttaggaatatcaatcccccgggctgccaaatccgttgtcaataataacttaatttgccgtttccgaaacatccgcattgctttttcacgttgtacttgtttctgtctaccacccaaagtatctaccgcaacatgttcgtgccgcaaccgacttgcagcatagttaagggtgcgggtactgttgaagaagacaagcgcccgaaaatctttaatactcgtcagccggcgtaaagttgctgttttttgcgcattggttcgtgcacttaagtaaccatgttctaccggtccctgagaagtatcctcatcccgcacatcaatagtttcaatatcgcgaccaaacatcacattcaattcatccagaacaggagattttgtagcagaaaagaatgctagttgagtagataacggggttgcacgctcaatatcttctacgacagctaaagtatcgtcctgaagcatgtcatcagcttcatcaataaccattgtcattagatggccgagctttaagtggtggttatcaagcatatggagtacccgtccaggtgtccctaccacgacatcagggtgttggtgcaaattcataacttgtcgccgtaaatttgcccctcctgtcagtgattgaacgctaacaccaattaaggttgcccattcacggattaccttggttgtttgaattgccaattcttgtgaaggtgcgagaaccaataattgagtcccctcgcctggcataatcttaggcaagagtggcaacgtaaaagctagagtctttccagagccagtcggtgctattccaaggacagattggtcagtttttaatgccggcgcaactgctttttggattgctgttggttgcttgtatttttcatcaaagtgtttttgaaattgttcgatcaaattaaatcatcctattcttgatcgttatcagatgggaaaactagttgagcagattgacgaagggagtacataactgagttgaccgtcttagataattctaaccaatgcttgtacttcttcatttcctcttcatcatcaggattgttaaagaggtctgcgaaatcattcatttcatcagtcattgaattttcttcaactggtgcttcaattgggtgcgcattttggtcagcatcatagtaagtaacctttcgcgtatcaaaaatactatcaaagactaaggtatccttcaagccgtaaacttcagaatagaggtgagagttggcagtcttaccgaagtttaaagtgacagtaaatttatcatagttaaggattgcaacccctttaccatcaaccccagttttagtaagcgttgggaagtaaactacagattctggttcaccataaatagtaacggcaccataaacagcatatacaccgaggtccattaatgctccccctgcatacttaagggtaaagatatttggatatggttcactgccattaagaactttgtcaaaacgcgatgaatatttcattacagtgatggttgcgccttgaacgtaatgttccttcatctcatcaactttcttcaaggcagcttgataaatcttggtatggatatgacgggctgcttcaaccaaacgagccttagggtgggctgctaataatgattcaattgcactgtattcacttggatttacgaaggctggtttttcaacaataataaatttatcattttcaattgctttccgtgcttgttgatagtgcaaactatttggtgaagcaatataaacaacatcaaagtcgccctcttcaaagaacttatcaatgtcatcataaaattcagttgctccatatggcttaccaaacttctcagcatgctctaatgttcgagaatagacagcagtcaattcatattttccagttgccttggccgcatctagcatctgatcagtaataatatttgttccaataacaccaagttttagcataaaatcaactcttccttttcaaatatttctttgcttatatttaattttaacaattattgcgcgtttttaacagaaatgaaatcttctgataatagaaatgtgtgtataattagttatgttataaaatgacttatcacttaattgaggagactgataaaatatgagaaaaaaaggaatgttacttttcggcgcgggactaatggctggactcaccagtactttagggttcagtcgtgcgaagaaaagcaataatacgatctcgttacccatcttttatgcgggcacatggcaatattatgataaagaacgagatcgctctcataaaataaccatctctcctgaattaaagctcagtatcgataaccaaatcattccggcaacggttcaacaaatcaaacctgataagttagttttccttgatcggtttggttatcacattactatccaggcgaatgagcaacggccaatttcattaaccgatgaagctgatgaccaagtttatactattcaaccattaaaataatgttggcgctgcaagacagcgttttttatttttaaattatttttgagtgctgagtgtactgacgatgtgccggtgccttatagttttgcataaatgccaaaatctggtcaaactggtcactaaaacagatactatttagataaggatcttccacaaagcccgccttattcatttgcttaaataaatcgtttaacgaatcataaaagccattaaagttgtaaaaagcaactggcttatgattatccccaactgttgtccatgaagcggcctcggtaatttcctctaatgtcccaaagccgccgggaaaagctaacaatccatccgcaagatccatcatcgtttgcttgcgaatatccatattagggacaattcttacatcttttaattcgttataaatggctccacgttcagctagctcagtagttattaccccgtgaacaacgccgccattttttaagactgtccgagcaagggttcccatcaagccaaacgcaccagcaccataaactaattcaatatcgcgttggaccagccattcaccaaatcgttgtgcttcataattaaatgctggatcatttccgtcacgcgcaccacaataaactgcaattcgtttaatcatacaactactcccctttaatattttttagagaatctaattgatgcttaattgttgctgccgcactcttaatctcctcttcttccaatgggtaaagctttaagaggaggaggttgccaatcccttgccgaccaattaacgctggaaaactgatgtaagttgaatactgcggctgataaattgcaaccggcaacgctaattgttcatccgcaaaaattgccgtaataattcggagagtccaagcagtaacagcactaacattataccctaatccatcgagagtgtaccaattactaaggttcgccttaattttaagctgactttgatctaagtgatgaccattgattgccgcagttaagggttgtccattcacacgaacagttgaccaagcaaatacctggtgaccatcgtgttgaccatagacaaagccagttacattggcagcagcgacctttgcggcttctgcaattgcccgataaaggcgcgcagtttcaacaaccgtgccaatcccaattacttgcttttgcggcaagccaactttttgctggagaacagcagtaattgcctcattaggattagtaaggttaattaagatcccactaaaatcactcttaaaaatcttattaccaacttgtaaggcctgctgatagctagtctcaagctcagccattggttgttgcttcatcaaagcactctttccaaaggcggtaataaggatatccgcatcggctaaggcagcgtaatcttgaataattatttttgtgtgggtcgctaaaaccgtttgggcatcatttaaatcggcctgaattgcaatagctagttgatctttttcatcaatcaaaactaattcatcaacttttccgttcattactaattggttggctagcatttcacccacatgaccgaggccaataattccaatctttctcatttttagcgcttctttctatttcccgggaaataacgaaagtgaaaacaaggttattaccctactttaaaaagatagagactaggaaataatctcctcagtctcttttttatttttcctgaaaatcctgaacttctgggaaatcactaagaattacatcacgggcaccctttgagaaatcaaaagttgcttgagcattataactttcttgatgatctcctacatataatactacttgcgttggttgcaagtctatttggacacctaactcaatggcagctttaaccaattgttgaacatcgtctgagtaaacatcgctgattgcttgcaatggatgttggaaattaatatttttcgtgtaacgatcattggcaatttttaacccaaatgataataaatcaccattttcaagttgatctgctaactgaccgctaagagttagtgaaggatcatccactcgtcgttgtacaaacttcaaagcaagctggtattctcgcggagcattaaactcaacaataaagttttgcaactctgcgattaactgcattgcttcttcatgcatccacggcaattgttcctttggcttttgtaaggccacttcattattccgcttttttgcttccgctaatcgttcctccaagttatcaggtaatggtgaaagaatactatttaaaagcattaattcaaggaagttaatcgtatcatcactaattcctgttcgcgacaacgggtcaaggtcaaaattacgaaattcaagataatcaattcctttatgtaaagccccatcaatatcatgcatatcatggttatgccgccgtaatcgtactgggccaaagaattccttcatactatagtaagtgccattgtccatgaagtgctttagttctgcaaaatgctggtcgtatgaagtataggtaacttgctcattggtaaagttatcatccccataatcactacaacgcaaacttcgaactggcagctccaaatcctctggaatactatgtggcatatcttcagaaaccggacttgctccatataagtacgtaaataaccattgataaaggtagaatttttgcgctaatttaaagtaaagatgattttgaaaatcaatgcggtttggataccggtctgcataaaagcggtgataaatctcgttgattaattcaccatccaaactaaaattaacatggacatcccctaaaatttcttgaacaataccatatttctttcctaggtaatcatgagtctcttggtcccatttcttagtaaatgcagtttgtaaatattcaaggtcatgctgataagtcggtcctggcgccatacttaacggccataatcgttcatcactccgtaaatgtgagataacaatctgctctaacatttttagttgccgaactgcatttttagctccaacaactggacccgtttcaaagtccatcatgtcatccgtatagcctgagttcaaataaatattatattgccgcgaacgcagattttcaggatatggataacgacttgcccgcccattggtcaaaattcggtgcttctttgcctctaaaccaaactgtgaagaaaaaagtttggcatttaatgacggttcttttaaagctgctttaagttgatcataatcggttcccatccaagaatccctccaatcaatcattttaattttattcaaattcaaccataacacttttgaaacataatagacaataataacttaattattttactggataatcacttcaaaatagattaacgctttctgtccttaattatatcaatctccgccaccaaggaacactaaattgctgatacgctttattcttagcaaagaaatgattaattccgctatttttacactgatgttcttttaatgaattgacataatcagcataaacctttattcgttgcgaatccggaacaccccgccacgcgataacatcctgcatattttttactaagtcagcataattaccgccatcatcataatcaataggtgcctgccaatattttttagcgatccttcgaagctgactatcggtcggttgagtaatatcaagacgctgatgagtatgccgatatttaccagttacataatactctccataaggaattccataattaaaagattctgtatcagcaatttgccgtaattgattggtcgaataatgcgtgggatctgaatcaacccttccttggttatcaaagcgataaatattccattgactaataaactttcctgtttcgatatcaacaataaattcaatcattcgggctggattagcataccgacgatacgaattacgaactaattgaactttcatattagagggataagtaaatttatgatggtaacgattatgataattagcaccagtcttaaagtctaatttaaagtgattatcgtgggcataggaaagcaatcgttgaaaatctgtcgcttctgatgaaagagagggacgctgatatcggcgaataaaagcgatgttttgccgatcaagataactgcgaaataaatgaattttgcgtcctaataaatctgcttttagccctttcttccctgaataagccgtcacaactaaatcacgaaaataaggatagaaaaaactggtgggggctaactgaggtgaaaattgatatacagttggtgaaaattgaagaaatccatagttatcaatataagcttttaaatggtgattaataattaaatcaagctgttcacgagcgttgagaccgctttgtttcaaggctcttatatagttaacggaaccaatttgatttacttctatcatgttatttgtcataaatatcgtttaacggttcatgaaccatcgtaacatgctcgcgctcggcttctataaaatggtcaccaacagatgcaaaaccatattttttataaaaatcttcaacataggcttgagcatgaataattatcttaaagttggggaaattcactttgattccacttaataaatgttcaataatctttccacctaaaccaatcccgcgtgcttgtggagccacaactacgcggccaaaagttacaacatcattctgaataaaataacgtgcataagcaactacttcaccattagtagtcgcaaaaacatggtgcgcaagtgagtcgctatcatccggatcaggataggaactctgttgttctccattaaaaacttgtgctcgtaacttaagaatggcaaaaagttcattaactgttagttcagtaaactgtttatcaaaccattgcataatttatccctcctataattttatatattatacaaaaactagtaagttagcataattttcccgcaaaacaattttattattaaatttatggaatataataaaggtaatgatttatttgtgaagggagcgttcaataatggataatttttcaccaaatcgtcgaaacgttgttgatattaccgacttaaataagtttttaacaaaaatgtatggtttaatgaccctagcagtattgctttctgccttaactgcttggctcgtaatgactgttttcgctcagcaatttactgcttttatggtcaataaccgctggggaatgtggttaattatcctcttgccaatcatcctgacgttggggattaattttaatgctactcgcagccctggcctttgtctgttcctattaattttaacagcaatcgtctacggaattacctttgcttttattgcaggtgcttatgctggcactgatattgcaacagctttcgtttcctcagcgagtgtattcttaacaatggcgattattggtactttttctcatcgtgattttacgcgaattggttcttatgccagtgcagccttaattggcttgatcatcgccatgctggttaacttttttgtccaaagcccaatgattaattatctgctttcgatcgttgccgtaatcatttttacagcgttaactgcttgggatgcacaacgaatgaaaaatatctatatcgaatgcaatggtcaagtctcatccaatggactggctgttcttggcgctttacagctttaccttgattttattaatctctttattagcttcttagacatttttggatcaagcaatgacagataaaaacattaaataacaaaaatggtcagtgaaaaaatgctagttttttcctgactattttttcttagtatattttttccacactaatgcctctttaatacacggatagtgacgaataaggattaatgtatatgtaccagttgtaaccgtaagtaatagccaaattacccaaccattatctggcaaaaacttaaaacgttctcgtaagacttcatctaataagtcaaataatagtcctttaaatgtcatctttagccctaaaaggtggtctgttgcaatttcaaccataaatacgagggcaaatccatataaataggcccaaccacgccgatatttaaatatatggttaccatatttatcttttttcgctgtttttacaatgcgaacactaaaggtttggaaccagccaagcatgatgccaattaaaattagaacaattgtaactagcaaatgccattcctgttgctccgtaaagatcgaaataatggtcatgactaatgcataaatcggaataattataaaactagtcttagtcacagtttcgaattgaaatgttcctttaatgaaattatataaaattaataggcaaaaaattattaagagagtcattaaacatccctcctaatataaatataagatagattttaataactctccactattacacttttaatcgtctaaagtaattcttttttcaaagcgaaacatttcattattagtatcattctgagtttcatagttaagatctggatggctttggttataaaattctacagcagcaaagccacaacggttgatataaaaatgaatatttcgtttatcaaaatacggggtacatgtctcccaaagaactgtttgtggatatttctgctctaatgcagtccaaattttataaccaattcctttattttggtgtgcagtatcaacgtataaaaagtctaaatgattgtgatgtgtttgatcatcgatttgtacaattgcgccacccacaatctcatgatctacaaccgctttaaatccgtgggcattatcacaagtaagagatgcataaatatcttcagtcggtaatacatcttctaaggagctatcctgtacttgagctgcttgattaaacgaatctttcatcgcaggaacaaaaattggtaaatctttttcattaagtggcataagcttaaaatccatcgttttacctcctaaaatacataaaactaaacgaccaataatttaagaaatcttaccatttgctgtaaatttttgaccacttattacatatacaatataagcggtgacaaatataatatacttagattagaaaggaagtgggaactatgaaagtaaactgtcatatcgaccctaatattgaagaggaacatctcgatttatttgtccgtgaaatgaatccccaaattagcaacctcctaaaaagttttacaagtaccgaaccagtattatggtgttatgacgcagatcaaatcatccccattaaattctcggatatctttgaattaactgtcgctaagaccggtactaaaatttcaacaaaagatcatacctacttttatcgtgaacggttatcccacttcaaaagcaatcttccgaatgactttattgaagcatcttgcagcactatttttaattatcattaccttgatcaccttgagttattagataatggcttgatagatgcaattttaacgaatggtagccatattcagatttcacgacgaaaaatcaaaaatttgaaagcgaggttaggactatgaaaaaatatgtcaaatatacgattggtttctcaggaatcggggttctaattggtctagcaatctctttagtcttcaactatcttgatggcagtaccatctactacccatcatcccctaattttgttaaccaattcgctcatccccttaacagcgtaactgtttctgttattttatggatgctaattggctgtgtttttgggtttggcagtttaatttttgaacttaaaaattggtcactgctaaagaaaacgatcattaatttttgtgcttactatgctggctttgcgccattagcaatcctatgtggttggttcccgctgacttggattaattttgctattttcacgcttatttttattgtaatttatgccataatttggagtcttaattggtattcgataaaaaaagagattcgctcaattaatcagcaaatcaaaaaatagatttttactcacatttgattgtaataagcctggactaattcaacaaagttattaatattataagttgttccaaataacttacgagccgctgtcgaccaataagaaatcgggtcttcgtgatcagtcccaccaagatagtttgaaatcattgcatgggtccaaacagttcccccaccatctttggttcccttcgtcacaggcaaattattctgttttaagatataggctgtataataagcagcgttgccaagctggttcgcaaaagatgctgcggtatattcatgaggcatttcaaactggacaaagtatggattagcatatggtcctgctccttctgccatatattttgtatccgcaatattaataatttgttgattatcaataaatgtatgaacaaacactctagttgaactataattttgcttcatgtaagatacttcactactaatcgttgaattttcattcccagtatcgtgaattacgaccccacgaggatttccagatgaagtactgtacccgcgttgttcaaatatacttaaaatttgtttagtaattttagcgtgtggaagaccagattgagtaagataactattgatttcgttgttcattttcagctcaatatcggtggcccgaacaaaataattttttccattatagttaatctgtgcgtaagtatcatcgttatcattagaagtcagatagtagcgattgaccttaactaaggcttgatcaggcaggttgacgcgttgaattgctgaaagtgaattatatattcttgcgctactgcttaacgtagccgtttcactaacagcatatgaattactaacctcccgcgtatgatgagaataaaaccaactcccaccgattattgccgcgacaattataataagtgatagatatattaaattttgttttttctttctctttgccatactagttattgtaacgaataaatttgaattttgtaggaaaaaactaattatttataagtaaagttaaaaatcccttgccgtcatcaatactgaaagcaagggatcattttttatttaccatccattaagcagcatcactacaaaacatgccatttacgtgattaacacctatgcaagtggtattgttaaataaaaatatttatgacattatatacttacaaaaaataagcaagaggaaggagtgactaattatgaatgtcgaattaggaatctcaacatttggtgaaacgaccccactcgaaaaaacagacaaggcaattagccatgatgaacggattagaaatcttattgaagaagtagaattggccgaccaagtaggaattgatgcatatgctatcggtgaacatcaccgcaaagactttgcagtttcagcacctgaaatcattatagcgatagcagctgcaaaaacaaaacagattcatctttcaagtgccactactaatttaccaacgattgatccaatttgggtttttgagcaatatgccacaattgatgcaatggctcctggaagaattgaaattatggctggccgcggatcatttactgaagcatttgatttatttggttatgatcttgataattatgatgaactatgtcaaccaccactgactaaaattagtggcttgtgagctgaaaatcctcgtggatttcagaccacaatttgcgtagatagggacaacttgcttgaccagccgaggctgtaatcaagtagtggtcgtctaattaccaacgccttttatgtccccaggttgccatagggacagataagctaggctagtttagctattcccttatcaagaatatttttagctgcgttccagtcacgaatatggtgagtaccacagttaggacaagtccatttgcggtcagctaacgttagtttgtccgtgccattagtacccatcacaaagccacaattgtgacatgtttgggtagtatttcttgggctgattgtgataaattgccgaccatacagatctgctttatatgctaacatgccaagaaaggaacgccagccaacgtcagagatactaagcgctaaagcatgatttttgagcatattcttactacgcaactcctcagctactactaaatcgtggttcttgattagtgcagtagagatttgttgaagaaaattatgtctttggttcattactttggcatgaagcttagcaactaacaagcgttgcttttggtaatttttactgtctcgtaaagaacgatgttctttttttgcacgccattgccgtctagataaaatacgctgctctttggctaatttgtctttaatagtgcgataatattgtggattaggaactgtgttaccttcactatcggttaagaaattatcagtattaagatcaattccaatatgtccgtgattagttttggactctttaacgaaaggtttatctgaagctagttgcattgatagaaagaagtgatccgccggatctttagtcaacgtcacagtaccaattctagtctcacacattctcttcaaaagacgtgcttgagaaccggcaacacgtaacagtccgattttagctccttacggagcttgatagggccttccatcccatgactaaagtcacgggatttccggctgaatatcattaaaatgatggaattgcttggcttaaagcgtttctacctccacttgccaattgcctcaatgccccataaagatgtattaaaagcaattgaaatttatggaaaagaagttgtaccaaaagtcaaaaaatattttaaggataaaagcaaattgaatgatttttcaattaaatggaaagcataaaaagatagacgtgagtggaaaaaacacttttttctcacccacgtctttttattactagagcttaatattctcaattgctaacaatttctttttgcgttcaaggccaccgctatagcccgttaatttaccattttgtccaagaatacgatgacatgggataaacagtaaaattggatttttaccaacagcattccctactgcccgtggactactattaagtctctgagctagttgcccataagtcaccgttgtcccataaggaatctgtcttaattgttgccaaactctttgttgaaagtctgtaccgttcaaatggaactggggatatgttaaaggaacatttcccaggaaataatcatctaaccatctaacggcatctttaattgccggataattaggattaagattgtccctttcagattgatcaacaaattttacttcagtgatcccaatcgcatctgcttgaatcttaattattcctaaaggcgaaaagtaattaaatctggcaatcattatactcttcctctttagttaaaatgtaaaatttcatttacaggacgacgctctgaatggtagctattaattgtcgtatcagccgaatatccaagcgagataccaacaataaaccgttcatcgtctggcacatctaaagtttgatgaagaatagctgggaaacgaacactgttataggttggaatcgttcctaaaccataagcagttgctgctaacatgatgttttcagcaaataagcccgcatcaaaaatcgaccaatctggtgaagctttaggaatagtaatataaagaattactggcgaatcatataaagtattgctggcatttgtcatcttttcatgtgcctcatcgaaattagcaaaatgatgaacaattccatgccgccattgcttcatattatcttgggtttgcggtgcccaatcttcacggctcatcactggcaaatctgaattcccttggttacctgcaatatcttgatcacgataagcattcttaatttcttgtaatgtatcgcccatcgcacaatatacttgccaaggttgagagtttacccatgatggagcacgttgagctaattcaacaattttagtaatcattttcttttcaacgggtttgtccgtaaattgacgaattgaatggcgttgattaattgcatcttgtaattccattagatgactcctcctaaatcacatactcttactaaagtttagcatatttaggtttactttaataagatcttgtattggtcactttatttctttcgccgcactgcttctctaatcttgggatagcgaaccattaagcaggccccataagtaaaactagttgcgacatttaacacccagatgaaccaggcgttgtgactacggaaaaatgcgattgtggataagtctttaagaacctcttcaaacagttcatgtgatatttccgtagcattaatatgggccccataaaatacctcaacactgatgccaattgcaaatgaaacaagccagcccacaagatacggccaattccttttaaccttcaaaattggtcgttgatgggaatctagtttattggtgtctttaatctgcgttttgcttgcctgtagaaagccaatcgaagctcctaagattagaagaataattgtaagtccagcggccgttaaagatctgacgttttctaaactcaagaccatcataattgcagaatacacggggataattattagctcaaatcgtgttaccttttcatattcaaatgtgcctttaatgaatttatagattaatagaattacaaatatagtcattgataataccctaacttttaagtttgtatttgtattgtactatatgactaagatagtgaaacggccaatttcaggaataataatctgagatagctaatgttagcaccaacatgtcccgtaacaatagaccattttcgtgaataggttgtacgtaatttttaacaaaaaagttccttttaatctcagtaacgcgaaaacctattttctggtaaaggtataactgcttaaagctcgtactcccagtaccaatttgcaattgttgataatgatgtacctttgcaaagtgaacggcatcctgcaatagcctggttgctattccttgattttcaagccgtggatcaacagcaatattctttatttctaatttatccgatgtaagttcttgcaaaaccattacagcaataggatgaccatctttagactgtacgaaaagcatccctgattgcagataattttgaactaatttcttacttggatcagcactgagaagcaaatcccaatgttcaggagttactgtcgttactaattctatccttgtatcgttattagtcattcgacaatccctcatccatactattgatagttagaaactgctgatgaagctgttttgaaaatttcattactcaaactccttttttccattaagactgtttgcacacattttcttattaaggagactaattcccacttacattacttaaggcaacaacccagcaaccttatcacctaacgttggataaatcgccattactttttggcgatactcatccccattaatcttcaaaccaataattggcaagaagttattaatatcatcagccgcataatcgccaatttcacttgcccctaccaattgctgatctttaaagactaaagtaagggtactgatttgatcgttttggcccgcgtaaagactaccatattttagtgaaactgtcttaacttgatattgtgagtcaccagtgacatcatctggattaacaccggcacgggcaacctctgggaaggtaaaggctgcttgaccaattgtcgggtaaacaatatcttgatccgttttacctgttaaatagtcaaaaagatattgaccctcaaattcagcgaccggtgttaatttaggttgtttccgattaacaacatccccaattgcgtacaccccgtcaaccgttgtcatcaagtgatcgtcgacattaataccatgacgatcatattcaatatcagtattttcaagcgctaatttttcgatatttggatgacgaccagttgcatcaagtacatagtcagcttgtacttcaccatgattagttataacgagcaagccatctttcctttgacttactttttgggtatcagtattaaagctaaattttattccccgttgcttcatcgcattaactagcacttcatcttccgcctttgtaaattcacgaaggacgcggtcagaatgaacaacgattgttacttcagcgccagcagctgctacaagggttgctaactctaagcccacaaagccagcaccgattatcgtaatccgttgtggaagttcttttaacgagaggaggtcataactggtataaagatattctttaccaggaatatccagaatatttggtgtttgccccgtcgcaataataatatgatcagcccggtattggtgaccatttacagtaatagtatggttatcaacgaaacttgcgtagccgtcttcaatatcataacttttcttaataatatcgcgagtttcacctggccatggatcaaaccgcttaagcttagtctgcattaatgcttcccaatctaattttgctggttgactaatgcctcgaccaagaagttgctgagattggaggacagtccgggctgctccctccagaaaaattttgggctcgcatccataattaggacaagtgcccccatattcgaagccctcgattaccaatactttacggtcggttttagccaaaagattagccattttataggctgctggtcctgatccgatcagaatatcatcatactttttcatgttcatccctccagattcttacattattgaatcaagtgtaacttaagtaatgaaaagagtacaaacgttttgtttcgtcgtataaaaatattaatcaaaactcaattaatacttatcctctttcatcatgaaaacgaattcaactaatgatttaacagtattttgtctaacctattgtatgatccattcaagaatgatagattagcctttaattattaggaggtggtctacatgttaaaagttaatacattatttatcatgaccgccagtattctcgtgttattgatgacaccaggactggcttttttctatggtggtctagtcaatcggcgccacgctaataacatgttgctaactgtttttatgatgtgtggcttagccgtgattctctggattacagtaggctattctctttcattttccggcaaccattggggaatagtcggaaatttaaataatatattaatgattcatgtgccaatcgatgctatcactaaaaccggtattccaattggtgattatgcaatgtttatgatgatgtttgcaattattaccccggcaatcttttgtggatcggtcgtcggtcacggacgctttaattttttagtaatgtttaccatttgctggtctatctttgtttactacccccttgtccatatggtttgggcaccacatggactattagcaagattaggggcagttgactttgctggtggattagttgttcatgtaaatgcggggataacggccttaatcctttcagcctgggttggtcgacggaaagatgttcgttctcaacgcaataatttatcgtgggtattaattggaacagcccttttatggattggttggtacggctttaacgctggttcggccctcgccgttaatgatacggccgtgcaagccatgttaacaacgaccatctcatgttcaagtgcaatggtaacatggatgttattggatcgttatcagtttaatcatgttaccctagctggtgtctgtaacggtgcaattaccggtttagtagcaatcactcctggagcaggttacgttacactaggtggttcaatgattattggaatagtcggtgcaatcgttagccaatactttattactaagatcaaaccacaactgccaattgatgatgttgttgatgcattcggttgccatggagttagtggtatctggggaagtattgcaactggtatttttgctagccatcagatcagtcatctagtacctaatgggcttttatttggtggcggtttgcaccttttgcttgttcaaatcttcgttaccttattgacaattatatttatcggtgtgatggatattatcttaataaaactgctctcaattattttaccggtttcgattgataatgaaaaactggcggcaattcaaagtaagtgagcttaaatttttgctgcaaaattagattatttacgtatatattcctttagaagcaaaaataacataccagcacgcttgcgttattaccaagaacaggttgatcatgagctattaagacctggagataattactcagtactcaataattaccctacttatattattatgttttgtaattttgactattttaagcagggatgggcacgatatgaatttaatcttacttgtactagagaccataatctaaaatttggtgataatcggacagtcgttatcttcaatgctcttgctaaaaaatttgataaaaatgatgaaccgattaagaacttccttgctttaatgtgcaatcaaggcgacaataagaatagatttattgcacagattcaagacgaaattgataaagtcaaacaagatccagaaaggagaaatggctttatgaagtacgaattaaacttaatggacgctaaaatggaagttcgcgaggaagacataaaaaagttaattgactctctctatgaactcaatattaaaccagagatcattaaacaaaaagttatggaaaaatataatttaactgatgatgaatatgataaatttctcgaataataaaaagagtgtatacaaatgaactttttgtatagcactcttattttattgatgtatctgatatccagctgcccaggcatcagctaatgaatcttttcaggggcaattccaggatctggatattgtcctggcaagtaacaatacattgtagaactatctttccctttgtccttagattcttttgtcgactttttcttcttatctaattctttggttgctttagcgactgaatcctcgtgagttttctgtgcctgattatggttactaataaaccatccaccaccaactagtaatagggcaactactatttatagccatgggcggcagtaaaatggtttctaatgttgtttcctgttcataactaacctcccttatatctggactttctattttgtatcaattattttctgcttttattatatagaattcatatgtgaacaagatactgcatttggaaaagattaatgcggttaattaatctttaggagattagttataggatattcataaatagataaaattgttaactataattaactaaatactggccatcatcaagtaaaaattgcttaaataatggcagcgtaaattttagttttccatatcctgccggtgttattagttgactatccattaaccgccgacgatacattccaatataaccaggctttctctttaactttgttcttaagtaactagttgaaacaggatactcagaagctttagccatagtcataacaaattgctgatccataatagataattcttcaagcatcttactgtaagcatttcgacttaattgggcttgatactctgtttgaatactatctatggttttcatcgtaatatgtttatccggtgattcccataaaagataaacaagcaattgaaaggcatatgcatatgcgtccgaaagaagagcggcgcggcgaaccactgctggcgaaatttccggatctcgtactttcaatgcttgttgatattgcgctctgatatcatagtaatttagtggggaaagacttattcttccgctacgtaattagaatgttaatacatgattattttgcaagtcttgaacatttttgggtaatccagtcatgattattgagatgggtagcccctcactaatcatgacttgatatactgatgctaattcaaccattcccgttacttcttgagcttcatcaatcattaccaatactttctgattatttttttctaatatttttaacattttctttaatacaagttgataatttgatgtttgtttatcattaagagtgaattttaagcctaatccaccaatttcaaaattaatatcggagagttggtcaaatatttttttaattttatttgttgattgttggtaaatcatttcagccaaacgccccaccatattatctccaataattaaatgaatagttatccacgtcggatcttgatcaatctgtttgccaacagaattcataaaaactgtttttccaactccacgatttccataaatcaaagtagttcgataaggagtatcaagcgctttaatgtctttaaccaattttgattgtacttcttcgcgatctaataacacagttggttgaataccaaaacttggattaaacggatttctcatattcttttcccctattttatatttctaatataattttatatctttactcaagttttatatctgtttatatcttaaattttatatgtaaaaagccaggtaactcccttctctaaaaaagttaggaattacttggctttttatcaatctaattttctactctaataaaagtaatactcatttcatcatatttgatatttagaactagtaatctttttagctaattcagtatttactaatcgaatagctgatgaattcttataagaatttcccccaaagtttaaatcaccataccaacaaattttttgatcaaaaacacaaatattattaccaattttttcttttaacttaaaatcgactttatttgataaaagtttatagtcacaatttctctgctttttatccaaagtaagggaaatctgactaaattttaccatttcattcaacatttcaatttgtttttgattaatcctttttaaacagataaaaactttcttagcattagcaagatcttgtctccatactggcaaatagtcatctttagtatagtaagcagttgaataactattccattgcttactatgaacaaaactatatccttgttgcttatagactcttaccctcttccgatacatctttgcaaatgtctcatcagcaatatcaacataatcatatacacgtaattcgtcttttttatctaggtttcgttctaatcgaccaagatattgctttgtattacctttccaagaaaaaggtaacgttaaaaataatgtatctaaacttggtaaatcaaatccttctcccacatatttgccagttgacaaaagaatatatgggtctttaatttttgataacttaatggataatttttgtgttccagtagtcaaatatactttgctagttttctgctttagttttgcgtaaagttcattaagatgtttaattcgttcactcaacaataaaatatgtcttccttcagacaatgcttggagtgcatcttttactatttgttcattacggtcattattttcagcaatcaaccttatcttttgcgcataagtatcacgttctaatttacttttagtttcaagaaaactattataacgcggatatatataacgagaaatcaaatattctttttcactatcttgagcttggtagagaatatttccacaacgataatacataaaattttctaatccatcttttctttcgggcgttgctgttaaccccagaacatatcgtgtgtttgcttctattaaagttttttcgaaggttaccgcagaaatatgatgacattcatcaacaattatttgttcatagtcttgaaatagttttgtacgctcagtagctgataaatgaattaatttacgaatattaataatatcgactaattttgaaggatgattacgagttccagaaataatttcaatttgttttttcttaacagatcgtccagtcttagttaattctttatatggcacatccttaattttcaaaaatcttaaagcagcatctcgccattgattagcaatgttaacagtagacacaataatcaatgttcttgctttacgccttgcaattagcgcacatccaacaaccgtttttccaaatccagtatgagcacacagcatccccaatttatttttatcaattttatttactgcttcttcttgttgcggccgcagggtacctgtaaattcaacattcaacgctttggacagagtaaattgttcttttaaataactatgacaattatcttttaatgacgactctactcctcgtggcaatcgtaaatatttaccatcaatttttgctgctgttaaaattgaaggaacatcccacacaggcatacgcattctttgtctcttaatatattctgggttactaaaagtagctaagtttaataatgataattgctcttgacgcgttaaattttgacgattaataaatatttccccagcaataaagccttcaacttttttaggaaaattttgcaaaaacgggataattaatctagagttttcgccttttagaattttcagatctttagtaattcgactaatgaaattttttacttcttcttcactatacttttttgtgctttctaattggtcaaataactgtgacagtgctaaaggctgaagattattatcagtaaaaatagactttttctcttttacatcactccattttaatggcaaagcaatcaaatttccaaatcctttttcaggtaatcgatcttgattaggaatcatacgatcaaatgatgacaaatcaagactttcactagtaatcatcgactctactaaaatcaatttaccaagaaatctagctgtaacttgccgcaattggttgactaaaaaatatccatagatgataactattaccagatgatgatatttcaggaagacagttaagatcatatttttggcaagtcctaattaccgccttagtcattttataaggttcagcggctgattgatgtttatcaaaatcaaaaactaatagctttgttttatcatcttttaataaaggatagatcccgtaacgatgatatttatctgaagaagaaatctgctcataaatcactttcctagtataaggaagatattgtttcttcagttttgacaatgcttctttattatttcgcaattgataaaagattcgccaattttttaatgctggactataccctttaccattactccacttttgagcaaatacatcaggacgacctgcaaaataatcagcatataatgctaacttttcactagttgttcttttcttagctataagacttaataattcctgttcactaacaatccaatccgtccctttatcagtggtaattgagtaaaatttttctttagtttcgtaatgccaatatacttgagtaacggtaatgatatcaccgttatttaacgcgtattctttacctatttccatgtagtttaactccatttagctagctactattattacccatcaagattctcgaaattttagattagccaaatcatttaacaacatcattaatcatatctcttaattcttcgctaaagccatttaaatcttcatctgtaattactttctctgatattaactgcaataaaatctgaaacatggatctcctcgatgcttcaacaataacccccggcgattttcgatctgcttttattcgtttttccaacttccaaaatttatttgctgccgaaccatcaccatctaatattcttttgtattcttggttaagtcgattcatatatctttcttgccattctggaagcagcttgttgaataattgccagtcacttttagagatattattcatttctccttacctcgcttttactttaattatacgattaaattgctttataaaattcgactttttgcgccttatactaacaccaaagcctactccaccccaacatggaattcacattcaaagatggtattaaagtttacatagcactccgctcttcgaatttggatgctatttttagttaatcataattgcatttcatattcatatattaaccacttatctttctatcaatcacaaatattgtttttactgatatattcacactatcaaatatatcaggaggcattctaatcatgttaattaaggcaaataatcttactaaaagatacggaacaaaattagctctagataacgtaaatttacagatcgatcgcggtcaattaattgcttacctaggtactaatggtgcaggaaaatcaactactatcaatcttcttactggtttaatgacgccaacctccgggatgatcgcacgccgtcaaggaataaaaattggcgttgtcttccaagatagcattcttgataaagagctttcagttaaagataatcttaactttagatcaaacttatatcatgaagatcatactgaatgggttcaccatttaattaacttaatgggtctcactcactttctaaatcagcgctatggaacattatctgggggacagcgacgaagagttgacatcactcgtgccttgattactgacccagatattcttttccttgatgaaccgacaactggattggatttacaaacgcgacttgttatttggaacctccttcaaaggctacaaaaggaacatggtctaactatttttctaacaactcattacttagaagaagccgaaaatgccgatcaaatgtatatcttagaaaacggcaaaattttagtttctggcttagcaaccgatattaaacaacattatgcaccaactaaattagtggttacaacaaatggacataagctacaaactaactactctgagaaacaattaacatctcaaaaattttcttttgatggtcttaattgttcagaagttattacattactacatagcaatcaagaatatatcattaacttctcatatacccccggttcaattaacgatgcttttgtcaaaattaccggaaaggagcttcaataatatgatcgcgttaattaaaagaaacttaaagatttactttgctaataagattggtgtcttgatgtcttgccttggtgctttaatttcattctttatttatattggttttttgcagcaaaacctgatatcttcatggcaatcattgcctcatgcaaaggaaatgttagatttatggatgattagtggaattgtcgccatcgctggcattaccacttcgtttcaagctcttggtcaattagtcaaagatcgagaaagtcgaacatgggatgatttaagcctaactgatttgacaccgttccaaattaattgtagctatttaactgcaacaatatttattagcacactaatgcagattattacattcttcatcatggcagtttactttattttagtagatagtattactattccaactactgcattgcttcctggattagtttttattgttttaggtgcaattggcgcaagtgctgttaatttaattattgttgatctaatccattcttctacgacttttagccgcctttctgccataattggcgcagcttccggatttatgattgctacttatatgccctatggaacattatccaaatcagcacaatttgtagtaaaattatttccaagtagttatgaggctgctagtttgcgaagccttctgctaaataaactaagcaaaaaatttttaccgccatccagtcggtaccaaatgattgaatatctgggtatccacttcaagattcatggttatcagttaaataattatagtaatgcattaatgattgtgggaatgtctatagttttaataggtcttggagctgttttggcaaatcgatatcagaggaagagttaattgtgcaaattcattttcagtcagatccattactaggtcctgacgatcttaatgttactgtgaacgctgttgctaaaaacgacaaagttattaagctgcttaattatttagataagtataatcaaaaaagtagctccttaatcccaataaaaacagaagacaggattttaactataaagcaaacagagcttatcaaggtagaggtaaccaaaaacattctctctttttatacaaaaagtgatgtaattcaaacaaacggacgactatatcaggtattaacaaggcttaacgaaaattttgttcaagtatcaaaacacgccattattaatttaaatcatttactttccttagaagctggatttactggtaacatgattgctaaattaaattttgatcaacgtgccgatgtttcacggaaatatctaccagagttagaaagaagattgggactataaaatgataaatttaaaaaggggtatccgttactttattcgcgggatgggttatggatctattacttatctcgcaattattgcatttctcacacataatatgactgtttctactactagtgtcattacagtgttcattattagtggattgatcggggaattaagttttgtctttcaaacagaactaccgtattcgatcgctctcgttattcacctaatcgggacctttattctatattctgtaatgatgctaatcaatcactggcctcttaattggcaaaccattgtaattttcattatcgtctatatcgctatttggctttttattcgtttgttagaagagcaacatattaatcgaattaataagcaaattagaaacaggcaaaaataaattttgtatcgcaatcatcgcttcgttactaaaatgaggtgatgatttttgtataggttaatgtccatacaatcagacgtttgataacttcttagtttcacatttgcttgtcgatctgtcatttcgttgcctcccttaacacttttcttttatataaaacgttaagtacacggttaccctacaaacgcctacttgactatcgaaatagaacatagaatactcgactagttagttcaaaataaaaagaatcaccatctttcaacgttacataaagttcacgttcaaagatggtgaagtggttaatttaactatttaaggttgagttttcaatgcaatgatcgccattattatctcattgaaggctgacaaagatttccgtatatccgttaccttacacctcttacaaaaatagtgagacgaatcatttaattaactggtttaattcgttgatgtccacagcgttaaggtcaattgcttctccacctaaccagtctaaaaggtccggatcaacttgccctttttggtaatcatcataatactgctctaaagcaccgacaccaccaatatcttcaataataccgtaaccacgggctttttgaacatgtggtagctcctcattagtaactggttgaattttttggacatgaagtttaaactcccagccgtccccatagtcataatgaatagttaatttatctttttcatttaataatgagaccgttgctagatcaagcttaacttttgtcatccctcctggcacaaaatcctctgactgagtataaaattcctcagtctgttcattaattgcatcatacaagtgtgccaagtcgccatgaaacatcaaaatcactgtttcagcaagttcctcaattgtactactacccttaatcacgaacgtacggcttgctagcggtttgaaatcagctaatttagcagtaattacatacgcttggtcatagttttccggattaatcaattgacggttaccaacattcgctgacgtatctgcttgtgccggagatagttcatcaagtaactgctgaataaaggaatcttgatagtcatcttctggcgcagctaattccggttctccattgataatatcgtagcttgtatctagatagtctacaacatccctagaagctgattggctcacgatccctgtgtgacttagaaaaacataaaaattggataacgtagcagaaagaagatcctcatcaatttgatctaacgttccggcaaaaaagatgtttggcgcagctaggttagtagtgaccgtgcaaattttattttttaacatgaaatggttcaaaaattgatccaagatacgacgagcagtcttatcatcccccattaactgaccatcagcactggcgataaactggtcaatcatttgctggttgttttggctaatcgcttgaactgttgctggattatctactgaggcttttccttcgtcatccgctttaccggatattctttattaaccaattggcaaaatttcattaatacttcctgatcatttccagatagagctaacaataagtagacaagatcattgaaatcctcagttgatgaaaaatcatcattatcgttaagggtttccttaaattctgcttggtggctagcaattatctgcaaataatttttaagctttttgttttcagcagatgggattggccggtatagattaaatgaaaaaacattttgcattaaccaagtacgttgcggatcaaccaaaaagggcatttcatttagaaagttaatggtaacttgaccaaacttaccctcgcctaatttgtcagtaaagactggcaaaccagtttcctcttctacatataggtagtatgttttattatcaatctttaccggactaagctgccaccgtcgtaaaggtttttggctaatcttaccagtattatgaggtagccgatcagccaaatcaggactataaaataactgcgccatgatgattgctcctttatttttgaatgtgtgagaaatgaattttattcgctgtctataaaagaaagcgaagggaatatcacttatagtttacagttgtaagaatgtccaagcaagttatgatccctgaacattaatccacagttttagcaaatttttgatagtagtaaccattttacttaaactgatattgggcgattttttgcaaataactttggcggcgttgcggggatgaccaggaaatcccgccaaagttaagccatttccgatgctcaaagccaagttgtttcagggtcgtattaacaaatacccgctgaatagcattcccacagaaaaaccgcaagtaccaagttggcgaagttgaagtagttaatacatagcaatgctggacgttcgtcagtagccctttaattccggtcctggttaccgtatgggagagatcggctccctctttcatcaccttatcaataaacccctttaacattccgggaatactattctaccagcaaggagttctaaaaattactgtccaacacgattttaaaagttctaaatatttgcgcaccaagggatcaactgtccctccttgatgatacaatgaaagttcttccgcagaataagtaggatcaaaatgttccgcataaaggtcaattaattgaaccaattagtcgaaaaaagttagaaattaacacttgaccatcgagttcatgttggatttgagttatactttttattgtgcaagacccctttatactttgtttttagttatttgtttttagttatttaaagtatagtccaaaggggcttgcttttttaatttttcataaaaaaaactgataacctcgcctgtttgacatggttatcagctttcaagtttcagttataaatgaataatttggatcgttcgcaaatgacgcgtgagtttactatccgcttccaattgggcaagcgtccgcgataatgtttcgggggttgtcccaaggtatgaagaaaggtccttgagtttcaagggtagcttaactttcgaactctgttgatcaaccatcaattgtttcagataagtcactacccgttcttcaatgtttggtagtcccattagccgtgtttgctgacgaagactttcaatcattgctgcctgtcctgccattagttttaaggcaatttcgctttggtggtgaatcaactggataaagtcttgccgattaagaatacagatatcactgtctgtagtcatttctacataactactatggttggcaacccccaggagccaggtttcaccaacataatcacctgtcttcagcattcgttgcacccgttcttcaccatcttcacttagttggtacattcgaccatggccactttttacaatcattaaccggtcatccatgtctggactcacaacaattgttccgcgcttaatacgctggtgatgaaccagctgttccacttggcgctggcgttctaaacttaactgattaaagagcggaaccaggtgaacacaaagttcttctttcattagagtatcctccatcatttaatgttagaagtcatcatcatcttcttcagtatacaaccccatccgtaaatcatgccccaagaagcgctgggttaaagcaatttgctttttgatccatgacaataattcagttaaatctactgctaattcgggccattcttctttattgccaagagcaatggccttcgtgataaagagaatctgcgtgtcaaaatcctttaccaaggcaaataattggtcatcccctggtaaatacttatcagcaccactttcttctagcatggtaaattcacgaaactgatccgtcgtcgttgggatactctcaccattctgaactagcagctgattcaggtgattaaatgcttcctgttcatgcgcaatccaatcatcgccatattgggataaaaacaatgccgcattccctttcgtaaacagctttgcctgactaatctttagtgaatgaattaataagttagcaatgatatgacccgtcatcgcccctgccgttggtgtatggtgatcaatatcgctctgttttagttcctgttgatactgttcttcactagtcatctgatagctcctttaccttaattccctgaaccgtgtatcccattttttcaatatttgcttgaacatcatcgggtgaagctttggccaaatctagtgtaaatttaacctttcccgcattgaacagtaccttcacgtcatcggtcccgtcaatggtttcaacacttttttgaatcttagttaggcatgatggacaagttaaaccatcaagtttcatcattactttttccatggttatcactcctttgttattttcattgtagtttagccaccgtaaataaaaattgattatcatcaattttgagaaattcgtttcatcaaccgcatactgttcaaaataacaatcagaatactaagctcatgaatcagcattcctgatgccatttcgatataaccaacaaaaagtccaataaacaatagcactaccgtcagtaaggcaatcaagatgttttcattcatattggtgatggttcgccgtgccaagcgaaaactggtgactagactattcagatctgatttcacaagtactaggtcggctacatccattgcaacatcagtaccggaacccattgccactgcaacatcagctgcggagagtgccggactatcattaatcccgtcaccaataaatgcgatccggtgaccgtcagcctgttgctgtttgagatagtcagctttcccttgaggaagcatcgctgcgtgaacttcatcgattggcaggttagctgcgatctgatgagcggttccttcattatcgccagtcaacattatgagtcgtttgacccctaacgcttttaattgtcgtaacgccgattgtgcctgtgatcgtaactgatctttgataccaaagattgccaattcatggtgatccatgctggcaaaaataacaatcgaatttccatcactcgtcagttgatcaatgagttggtcgagagttgaactgtacctaataagtctttaatcagggttggattacctaataagtactcaccttcaccaatttgcgctcggattccctgtcccttaatcgtttgaatatcggttggttgataatcgtgcttcctatctagcttgccaattgcttgtgccaacgggtggtccgatcgttgttcaactgctaccgcttgatcaataatcgtctgtcggtctccgttcagaacattgacactagtaacaaccggcttcccgatagttaaggtacccgtcttatcaaaggcaatcgtgtcaatatgcttcattcggtccatgacatcggaacccttaaagagaatcccctgacgagcaccattaccgattccagcaacagtagatgcagggacaccaatcacaagcgcacctggacagccaagaaccattacggtaattgctaaccgcacgtctcgtgtaatcaagccaaccataattgctaccaatagcacaactggcgtgtaataacgggcgaagcgatcaataaagcgttgcgtcttcgtttgcgaatcctgagcttcttccactagttcaataattttaccgaacgtagtatcttcgcctgccgcggtagtattcaccgtcaccgtcccattctccaaaatggttcccgcaaaaactgcatctccaggatgtttcttaactaaccgggactccccagtaatactggcttcatttagaacggcagtcccagtcttgatcgtgccatcgactggaacctgatttccagtcttaattaagaccatgtcccctggatcaatgaagtccacatcctcatcactggtattgccatcttcatcaatcaccaccgcggttcgaggagcaagttcggttagctgcttaattgccgaccgtgtcttccttaaagtagcgttttctaatacctcaccaaccataaaaagccaggtaacaatcgccgcttcgttatattcgccaatgataaaagcaccgatcaccgcaatactgacgagaacatcaatcgatatcagccgtacctctaatgatgagatggctgtgaacaaaatcggcaatagaccgatgacccctgcagtggccattaggatctgatacattaagttatttgagctgataaagcgaaaagcttctgccagaattaataaaacggtcaagccgatcaccaatgcttgtcgttgctcagtcaggaatcgttgtactttgaccatatcggcacctccttttactgtccttagtataagaaaagaagccagtaagttacttgaccgtcatcaagtttggtaatttaaaaagcctcataattggattaaccaaatataaggcttgatacgtgtttctacttatttaatttgctaatgatttcattaattgaatatttgatttagtttgaatcagtccagcaagatatttaccatcatcaatactcattgtggatcgatgattcagccaaaagatcggtgaaggttgccaactgttcggtagcactgtttgatagacgaacaccaattttatccttaatcaggcggatacaggcagtgtcagcactttcatcccgccacaatagggtttttggtaaagcccagtggccctcaaatggcggataagcccgtttgaccagcaggacttgtggtaaatgggtcaggggattaaaactccaaataatatttgcaatcgtaattagcggatgcgcaacaactttgtcagccatctctttcacctcacaaaatattatagcgcaatcaagaatcacaattatcgacctctcacaccaccgtacgtacggttccgtatacggcagttcgacaacttaatcactttgaattgactggagcgtcttggacatattcataagtccgagttgttccagttttctatttgttagagaatagctcaaggtcttactgtgtgcagttcgccagtagcccttgcgggtactagcgaagacatatgcatcacgctgggacagccccagcttctgtaagttagttaccttagttttaagtttcttccattgcttccagatatactgtcttattcgggccctcaaccacttgtcaaggcgttgaataaagtcagttagtttcccaattgagtagtactgaagccatccacgcatttttcgctgaatttcttcaaacattcttgtcagagatattccacgattacgtttagttaataacttcaatgctttctttattctttgttgcgattgttttgctggacgggcgtaggctccattgtggtctacacccaacgaaaagccaagaaacttcaaccgtagtgggctaccgactttggttttatctgagttcactttaactttcaatcgcttttcaagaaactgggtaatgcttcgcattactcgttctccggctcgttgacttttaacataaatgttacaatcatccgcatagcgcacaaagtggtgaccacgtctagtcaactctttgtccaactcatttagatagatgttcgccagtagtggtgacaatggccctccttgtggggttcctttttcactcttagcgaaaagcccatggtctaagactccgctagttagaaacttacgaatgagtcttagtgtccatgggtcatcaatatattgttggagatacttaatcatcaagtcatgattaacgttatcaaaataggcttttaggtctaagtcgacaactcttcgataaccttgattataaagatctactacttttgcaatagcgtcgtgagccccacggtgagggcggaagccaaaactattatcagagaaaacacgctcaaagataggtgtaagaatttgggccacagcttgttgaaccattcggtccaccactgttggtattccgagttttcttactccaccattaggcttcggaatttctacccgtttgactggtgctggtttatacttgccctcacgcaaactagcgatcaattccgtcttattttctctgagatatggcagaaggtcattgactgtcatatcgtcaatgcctgctgcccctttatttctcttaactcgcaaataagcttgattaaggttattgcggtccaagactaagtcttggatagtgacactcatacctttaccttcaccataatcggtactacgcgcccttgtgtactttcggttttccaaacctatcctcgacaagcggtcagcttgttgttctgttttctgcgattgtcgcacctgattacacctccgatataagttacaagttattgtcgttcagtccttcatctgattactcagactactatgacctcagctgacttctggcttactcaacgctacatcactgcaccgcttgtttctgtggaattaaacttattcctcttgtcggaaacgtgtaggccagctctccccgggtaaggatattaactttcgtaccatgtcaccggtagctttactgaaagtaacttcgagtagtattggacttcaacttgtcatgcagtcttatccagttagttccagccttatagctacttcttgttcatcggtgcagtactttgccttagacttccttcagattccacctcacagtggacacccttgtcctcagctcatgtttccgactactacggtccatagcggactctcaccgcctagctaatacccatgccgggcgcacatgtaaagaaaatcatcattttagaatacaacatcgaattcaaaaatgatgactttcaaaatatgaatgttcacttcaaatcaaataaatgtaagaaacctattattccaaatattttcaaaaaaattgatagtatcttcagctgtcatatatttattatcaaatgtactgctagcattgtgttgcattattacttgatatcctaatccatgtgccattttaattgttgcatcaacacagtattcagtctgagctccacaaatttctaaattattaatacctaagttttctaaaattttctttagattggtttgataaaaagaattaggatgctttttactcagtaaaatatcgtttttcttataatgcaaatcggacacaagctgccaagcaatagaatttttttgaaggaaattatcttcgtgctggataaagataattggaaaattctggctccgatagtaatcaatacgtctatttatttttgatattaaattttcatagttaaaaataacttgatctgatttacaaacaccattttgtaaatctattattataagagctgacttagtcatatagtctccttattaataattaatggttcaaaaaaatcccgtaacgttaaaatgtggatctttctacttatattctttactttccctgtcatacttctttagcaaagtgtgatgacagattttgctttttattacgtactagcactatgagcgtttcattagataagattattgatcttacgtatccatatctatgaagttcatcattattattctctaaaatacttaagctacgccaactccagcattactattaatttcatcaattgctctttttactttgaaccaaatatttttatctgattcaaagagttctgaaattgatccttgatttgtaaatggagattcctgtaaaacatgcatatcagttaatgtaccatttttaacaatatactctataatttcatttataaaatatatctgctgtttattaagtgaaactgtatctaaatatttattaaaagcttctttggcagctttcatatctaaaccaacaatactacgaacaaattcaccaggagttttatttcctatttctttttgatactcttctttacttccaagtttttgccatagaatattctcgagctcttttatatcactgctatttaaaggtgcattatctttaattttacacattatattttcactttgatgttgcttaatataaaattctgcttctgctttgtagtttttcaaagtagaagtttcaagttcagcttcatgaacagttgaatctaatatactatcagtgaaatttgtataatacactactcccttttttggaagatattgaattaagtcccgtatattttgacggatatgctctaaatcttgaacatttgcagattcaacatattctgactctgacataactttaattaagtcggcttttgctttaatctgtgggatagtcattaaatcagataatttagaaattttattacagagatctacttttaatcgtccataggattcttgtgacatttttgccagttccattttatagactaaagcatcaaagcgtagggcatttggttcatcattatccggaagaattagaggtgctaactctttttgaacatttacaatgtcctcataagttaagttattgtaattatctatttgagaaaatttatcaacataggcaagatgttgtttaacagcaaaattttttctatttaattctttaacttttttagataaatcttcaactaaaaagtttcgatactgcttaaaatcttctgtttgatatggggcttcttgtaatttccgtactaatttcattttcaaattgaataaagcactttgtaacgtttcttgggcccccgcttcacgtccctttttcatacggaaaaattgaaagttatcgcaaaaatcaaaaatgtaaaattcttctttatcttttccatctaacaaatttggacataaacgtgttcctcttccaatcatctggaagaatttcgccttactcattacttttttgaaaaatactaaatttaaacattctggtacatcaattcctgtgtccaacatatccacggaaatagcaatttgtggtaatttatttggatctgaaaattcatcaattgcactttgtgcgtaattagtataattatcaattacggttgcataaggttgaccatttttacaaaactgaggatattcttcattaaaaactttcagaatttcctcagcatggcgatgattcttagcaaagataatagttttacctattctttcgccataattaatctttagtccctgactcattaaaatattcaaagctttgcgaatagtgtctttattaaataaccacttattcaactttcttgattcaatcttctttggcagctcaccatcttcatctgtgaaagtttcctcatattcttccttttcttgatcagttaaatcgtcataattaatacccttttccataaattttaagcgggtctctattgatctgtagggtactaaacacttatctttaacagcttctgctagatcatacccataagtgggcactccatcttccaagttaaaaatagaataggtatttttatcaatatcatctttaggggtagcagttagcccaactaatggtgcatcaaagtaagtaaagatatttctatatttattatagattgatcggtgagcctcatcgacaataattaagtcaaaatgtcctgctgtatacagtttttgcttttcgtcatctattgctgtatcaatgacattcatcattgttgcataggtagaaaaaacacatcgagcgttataatttttcttatcttcaactaaattagttacggaaagatcaggtagtaaattgacaaagctccttttagcctgtgtcactaaagcatctctatcggctaaaaataaaatatgtttaatccaaccagcgtttaaaagaactttaactaatccaactgcagttcttgttttaccggatcctgtcgccatgactaataaagctttacgtctattttcttttgaaaaactttcgcaaacagcttgaatggcagccttttgataataacgtcccgcaatattatcatctactacaatattcgttaaaggttggcgtactttttgcaaattaaacaacttttctaaatcacgcttagaataaattgatgaaacttgtctctcagggtattgattatcaataattcgtgtttcaaatccattacttaaaaatataactggtctacgtccatacttattctctaatatatccgcatatagttttgcttgttggcgcccaactgctacatctttacaagttttctttgcctcaataactgcaagaggttgatgcgcatcatcatataagacgtaatcggcatatccagtaccagctttgttaggcattcctttaagttctacttcgtttaaccaattttggccctcaatccaacctacttcagctagcatagtatcaatataaattttacgagttttaaactctgagattccaaatggtttaggagtatagctctttccttgtacttttctttgcgcagttaaagattcctgtaaaggtttgttctttttcgtaagtttttcgagagaaattgttgactcttccattggagagactttaggaacaaactccagacgataattcccaacaatcgacttgtcaaaatctttcttttgataattgcttccataacaataatcaagcatatcaaaaaagctaaataaagcttttaaacataaaatagcttcatctagagatacttttctattagtgtgtacagcaatatttcctaaacgacgaattaattctaggccttgccaagtattaggatcaacaatatccttaaaatctagagtattgattaaggttactaatttatcctgatagggagttcttaagtctgagtcaactgaatacatccacttaaccgctaattccattgcacgtcgacagtcaattactgctgttgcaggatcaataacggctactttttcagctgctattgctatttgcacgaaatctttaaattgtggttcttctagtaaataatcaaagttagtcacggataacatctcctatttgactaagaattttgtttaagagcgttttatttaagtatactatattttcaaattttgatttgtcgacttggtggacgaagtttgcgtattcattttggagggaaattggtggaagtataatttttaacatttcaagttgctttttagtaattgcttgtctcgttgccccacccgataaaccaatagacaataatattcttttaaaagaatcattaagaaacaaattattaataaagattggattcaatacatccgatttgcacctaataatagaaacatgctgattcactcgtgcaggtaatatatcatcaggtacaatacaagatctagcaacagaagctcctgtaatatttataaatacatcttgagactgcactattacatttgaaagttgcttggcttgtgttgaatttatataagctaaatccttgtaattgaagtatccgtcatgaacattcatactccttataaaactgatgccatgatcttgatagctttcttttccacctttaggagtggcgccagagccaatcttatcaactaaatcatttaataatcgtttcttccagctttttttattacttatcggatcaccaaacatctcgacaaatcgggctttgattagtttgtcaaaaaaggctaattctttttgtctaactttaataattcgagttaaactatcaagaatatcaactatatttttttgttcgttaaggtccggataattcatatttatttgcttaagccatttaaaatgacgattatatcccgtatttggaatatgtgctgcttttaaagcatagtataaatatttatagttagattctttttccttactctttaatactttcactccatctgcaccaagaaaaaaaggtttatcaatatatttcactattcttgtatgatctccaaaaactatcactgggacctcttcaaatatacctttttgacgatctgtatatcctgcaatactatcttttccttgatcaattattatattttttcccgtagttaaatattcatctttggggatttttgttcctgttttagtcacatcggtaaaaagcgctgtaaattttttatactccattaatcaccctacaaacctgaatttgctaggatatatattttcgatgtgctgctttcacattattttgattaacaatagcgtattgcattgtagtgtctatctgagaatgacctaaaatcttttgaacttgttcaattggcatacctttatcaatagctcttgtcgccatacttcgtctgaacttatgtggatgaatcctatctaagtgtagctttcttcctaattggcgtagtctaatttctactccactaattttcaatcgatcatttggcttatctaaagaaacaaaaagcgcaggattatcatcatttctactccttaagtaattaatcaaatgcacttttgacttagcatcaaaatatactcgcctttctttatctccttttccaaacacaacacactcacgttcagaaaaattaatatcagttctgttaagtctaaccaattccccaactcttatacccgttgaatacaataaatcgattatagctacatctcttaaacaagaacaaccatcacgaagtttttcaatatcttcatcagttattacattcttcacaagcttttcagcccgaattttatgaatacgacgcataggactctttaatatatagtcttcttcctcaagccaggaaaagaaacttgaaatattacgcctgatattgtcaatagttgttttgccacaattattaatcttttgataatcaaccaaatattcacgcatttcctctgtagtaatccttcttaccggtctaactactttctttaaaagttgttcaactgtaactcgataatatttgattgttctatcagagcaaccttccatttttttagcttccaaaaacttcgctaggtattctttattactgattttccgtttttgtggctctctttctactaaatgcttcaacattacttcttgaagtcgttttaactgtgaggcattaagcacttcggccatctcatttattatttcaacaaacttttcattcatagtgaatctcccaaatttagagtttttcactattaaaccacttttttacccaaaatattcttgcattaagctatcatataatttttgtgtctcatcaagcgatttttgaattacaacttttgatttgtcgacttgttgaacaaagtttgcgtattcgttttgtgaattcaaatctgcaactggaacaataatctcatttagtgttttaactgctagacctggttgagctgctccagatctaaatcgattaagtttttccaagtttaatagttcaaatagccaacgactgttaatctctatattcggacttactaaaatagcatgttcagtatttctaaattttcccgttgcaaacttaacatttccacataaagcaccttgtcttccaattaaagaataatttccttgatgtgtatagttatcaacatatcctcttataccatttcctccaaagcagggatacttattaatagatgttttaacaggagatatttttttagaaggggtaaagtcgccagcttttaataagcaaatgtcacctagttttttcttttttatatttttattgttgataatcggatcaccaaacatctcgacaaatcgggctttgattagttcgtccagcttaagcaattgctgttgcttattacttatcattttttctaataaagaaaatctccaaataatttgttcttgttctttttttgaaactaatacaaatctttcgtgcttatagtttttaaaatatatatgaggaatagtagcaccagaatagtatttttctaaatgcatagatgatactgcgtaatacaaatacttgggtaatacatttttctttggtatcaaagcctgcatggttccaataattgaggaattgctaggtaaatatgttgctcggccaataccagccccatcttttaccacaccaacatatggttcatcatattgaaaagaattcataaagcccactggaccagctgctccatagacaggatatcttccactatcatttacatctttttgcctgatatttgatgtaccttttatacaaacatctttaagtttcactatcaaaattcaccctacaaacctgaatttgtttttcctttctagtcttttaaaagagcttttaactcttgtaatgcgtcatttgcttccttatctaacttttcaatttcagcaataatctcttctgttggtggatatttaactggtttatactcaatttctttataccgattaattgaaagatcataatcattgtcaacaatatctttcttatcaaccataaaggatttatttgtctttttacggtcaacctctttatctagatgattaaaacgttcaataatatcaggtatatcattttctttaactggcgttctcttgtcatcaagagaaaatccatcagcagtcatatcatagaaccaaactttatcagttcctccattacctgtcttagtaaaaatcaagatggcagttgaaactccagcataaggcttaaacactccggaaggcattgaaataactgcttctaaattgttattttcaattatttcttttctaattgacttatgtgccttagatgatccaaataaaacaccatctggaacaatacaggcacatcttccacccacttttagcatttgtaagaataaagttacaaaaagtaattctgtttttttagttttacaaattttaagcaggtcttttgaaactgaattataatctaggcttcccttaaatggaggattagccataattaaagaatattcatctctatccgtattttgttcagataaactatcttgatactcaacattaggattatccactccatgagataacatattcatagctccgatacgaagcatggtttgatcagtatcgtatcctgtaaacatttcattatgaaaataatgtcgattttctttattataaaaaatttcttctttcttcttatcttgaaggaattcagcactttctactaagaaacccgctgttcctgcagctggatcacaaattttatcagtaacttgcggattcattaattccacaatcattttgataatgtgacgtggagttctaaattgaccatttctacctgcagtagacaactttcctaaaagatattcgtatacatccccacgaacgtctcctctgtttataatcagagctttctctttatttttagagttatctttttgaacttcttcatccatcagtcggtaaatatcatctaattctccaatcaccttagatagtagaccgggagttgggatgaggaaagttgcatctttcatgtagcgagcatacgaaccttcttcattatttttcaaattcttaatgaatggaaatacctctgtttgaacaatagtaaacatcttttcaggtgcaaaatctttaaatgtggaccatcttagctcatcgccattaactgttagatcatcatcaatttttacctctccatcaaaaatagactgataatcgttcaatcctaataagatattatccttttttcttctattatctgaatcatccaagtccttgataaacattaaatatgtaatttgttcaattacattcaatggattggttaggcctcccgttgcaaaggtttcccataaaccatcaatcttactttttagttctcctgcaatcattattaactcctaatttttttatatcgataatatttctattttaccctgagtaattatttcataacaagaccatcaattaatgacgccgttttattaatattatacgtcgaatacaccaacgccctgttaattttcttttttcagcaaaatcgctaaaattcaatatcgtacttatccacttaaccattattcttagatcagcctactttcgtaccaattaaaatgtccttcatatcaacctttgctctcacattcgctactctagtccatacgactgttcaaactggacagtcgcacactcgacccgctaaaccaaaataaaaaagtgtactaattccaatccctaaaatcaaaattattacaccttcaatcacttataaatgcctttgtaccagcaactataggctatttcctgtccgttcctacacagtatgctcctagccatcgcttggcgcactggggacgctatcgtgtggagcgtttctaacgcttgaacgcttctgttagtcactctctgagttattcgtaagtaatcgagtttcgctatactcgctccaacaatgtcaccgactcaacatatcctagcgaccttgctgtcaagcctaaaacatgcccaaaagctgcccaatcaacgtttttactactaactaatcaacttatcactactactacccacaattagtccaccacaaacacatttgtgtctgatagaccaatatagtttatagtcgtttgaggaaaataatcaaaaaaacgcactctaatataatttaacaccaatctataccgaaatatgtttctgattcatattcattcctgatctcctgctcgacatccgcaatagcatcaagttcagtatcgcaaccttcaagaaaatttactatggcctttagataaacatatatgttactcaaatcaagagccctattatcaaaacgatattctaaactatatgaggttggataacggaaaatatccccatttttatctagcttatttatttcaaatagcattttttcaactaactccgtggtttttaactcctcatccgagacacctaaataattgacaatcacatcttttacatttttccacaaatctttttttatacgatgactctttctttttgacttaaaagcctttttcgagacacctttttcaactcggctataaaataatatttttaaacataactctatagtattcctaaacataaaaatcaatggataaagcttatcttcatttgaaatactatcaacttgatagataaagtcaattacttcagtataccccatgattttgacatgaaagccctcatccaaaaggctttgccataagtaacaattttcagaactacgagaagtaaaaataaagaactcaggttttaatgtattattaaattcctcttcttcagcaatatctcccatttccaggcacttctttactaaatagaaagcctgtagcaaattgttagcgacctgtatattatctaagaatttgtctctgtattttgaaagaaattcatcgtcaaaagggaatctaaaaacatcggattttctatctacctcttctagagaatcacagtactttgataaccatcttttttctctattatttagaaaattctcatgtccaacttcatcatatttttttaataatgaagctacatcatgaccaaaatttttaaacgtatcttgaatatcttttttttgaggtaataccctacataataatgatttcaaccctaattcaagactgtggcggatcaaaaatatacctgttaaaaaccacatatctgacttaacattattaaggttatcatttattacttcctccaatattttatacccacagctataaaattgataagttagtcttttatagtctaaaaaattattgcgactccattcgactactacttttgtgtcattattttctattttccaaaaatccatatccgaagaaggccaaatatacacttaattactcacttccctaatcattgttcataagctttaaaattttctgtcatatcttcttgaaaatttcctcatactattctgggggaaaacattttcataaagatagaattacactggatattaaagctacagtagttagccaaaagtacaattttcctacagtaaaatatctatacgttgaaaatgaaaataccactatacccaataaaataaatatataaggaacaacttcataattttgagaatcctttaacccatctttagctattctagaaaaaacctcaccagatttaatcttatcccataaattggatagtaaaaaacaaatcttctagtattaaagtgattaacaatataaaaaaggatgctctttagtaaattaatcattaattcataaatccacctcttctccttaaaagttgcactcttgctttttaagtgtactaagctttaccccaatccactcaaattgctaaagtcctctcataataagcaaatttatcaaatcaccactatataccataacgttggccttagtctcacttccagtacggcaagccatccaacctttcaacgaattttaatcgttttgtgctcgttccagcaccgttactgactcaacatgcgtcgtctgtgggaactggtctactggctgaattggctttgttacatggtagccttggtcagcgaaccgcttgatatcacgaactaaagtagctgggttgcaggaaacataaatcactttcttcggtcccatcttaccagtagcttcaatcaatgattcagccaagcccttccgtggtggatcaacgatgacaacatctggtttgagcccttctgcttgccacttagcaaattgttcttccgccttaccaacaacaaatttggcgttcttaataccattccgtttagcattatgtttggcatcttcaatcgccgctggaacaatttcgaccccgtaaacttgcttagcgtgcttagctactgccagggaaatcgtgccaattccacaataggcatcaatgacggtttgattaccgtccaagcctgcattgtcgatggctgtttggtaaaggcgttcagtctgttgcggattaacctggtagaaggataatggtgaaattgcaaaatcaatcccgaggagctgatcatgaatttcatcagcaccccataacgttttattcttattgccgagcaagcggttcgttcgcttatcattgatattttgcacaatactttttacttctggcactccggcaacgattccgtcgacgatttgcttttccattggcagccgcttcgtattcgtgactaagactaccatcatttcatggctgtagtatccccgccgaaccattactgtgcgaatcacgcccttaccagtttgttcatcatatggcgtaatgtggtattgtcgtaataagtcacggacaaccacaatggccttatcaatttctggatcctggatatagaaatcttcaatgggtactaaattgtggctcccccgcttataaaaaccggtttctaattgaccgtggaccatttttactggtacttgggccttgttgcggtaatgataaggcttttccatccccatcgttggcaaaacttcaatctcatctaagtgggctttagccaataattcttgaatttgatgttgcttaaatttcagttgagcatcgtatttcaaatgaccaagtggagcgattcccgtttgaatgtactttttatccttaacatcaacgcggtctggactcttcgtctgccagtccattactcgtccccatgcaaagtggctggttactttggtgatctttaccgtaatctcttcaccaggaagggcattaggaacaaagacgggaaaatcatcaatcttaacgaccccattgccttcgtaagataaatccactacttttgcgggatattcttcatttttatgtactggaatgtttagtttcaaagttattcctccattaatttcaacgttacaaacttctcctattataacaaaacaaacggccaacttcctctttgtgaagctgaccgtttatgcttttacgcaatgcttttctaaaaagtgcgaaatttctatcatttcttcttcagaatcgtcggctaaggttatttgaacgacaaatgcctcaccctcatctgcgtttaaatgtaattcccaactatttattctttaagcactccatcaattctttattctcatcaaatagttgattaatcattgtcaatattttatcgctgctctgttctttatcatttttagttaattgcaggtcaacagaattatcggttttgaagaatcttgaactattatttaattctcccacattatcacctcataattacattatagaataatgtaatcataaattttccattataacaaaacaaacggccaacttcctctttgcgaagctgaccgtttatttattctatttcttttcgcgatctttataatcgtcaatgccattcataaagtctttttcaacccgcttaaaatcagctgaagttgtaatcgcatcttctggaatctcatccaagttagcaattacttctaggtgctgtttaaggttatggaatttcattggcgcatcgccaccatattccccgtccaggttaaccatcaagcggtcatccttgtttagcggaataacttcaatatcggttgccttagcataaataatgcgcggatcatcaaggtgctttccttgaagtgcctttgccattaagctgagcatatcgatcacgctgctcttcttgacgataatcatcgtaaactttccatcatcaagtgaagcatccggcacaatctgttcaaaaccgccgaccgaattagtcaaggcaatcataaacatggaagcactgccccggtattcctgattatcatacttgattagcatgtcgactggcttaatccgcggcattaactctgctcccttggcgaagtatgctgcataaccaaaaagggacttcatttgcgaagggacctcataggttaattcagtcatcgttccaccagcagcaatattcatgaagtagttttcaccagcccgaccaatatcaatcttaaatttcttattcttctttaagattaacttagccgcggcgatcggatcatcacgaggaatccgtaatgcccgtgcatagtcattagtcgtccctgctggaataatcgctaatgttggccgatgttctaacccagcaattccattaaccacttcattcagggtaccgtctccaccagcggctacaatcaaatcaaaaccgtcttcagcagcacgagtggcttcgttcttagccgagttaggcgcaggagtagtcgcaaaagcactagtttcatatccagctttctcataaattgcgagaatatcaactaaatcacttcgcaatgtttcacggcctgaggtaggattataaattatccgagcacgttttcgcacggtcatccctccctactctatttagccttcaaagacttcatcaataattgagtaacaacttgtgggttagccttaccacgcgtttgcttcatgatttgacccattaagtagccgacagcccggtctttaccattcttaaagtcttcaattgattgttcgttgttatcaaggacttcatcaacgattggctgtagttgcgcaggatcagataactgaacaagaccgtgttcctttgcgtaagcatttggttcttcaccatctaagattcccttgaagaccttcttagccatcttagaagaaattgttccgtcttcaatcaacttcaccataccggcaaggttagatggagtaagcttggtatcttgtaagtcaacttgcttatcgttcaagtatgagttcacatcgttcattaagtagttggctacccgcttaggatcgccaccgtccttaacagcctcttcaaagaaatcagacatttccttagtctgggtaagaaccatggcatcgtaatcagttaagccaaggtccttaacatagtgctcacgacgctcaccaggcatttctggcatttcgctttcaatttcactaatccattcatcgctaacgtttactggtggcaagtctggttctgggaagtaacggtaatcatcagaaccttcctttgtccgcatcagaatagtctcaccagtcgcttcatcataacgacgcgtttcctgaccaatgtgtccaccagccatcaatactttttgatgccgtttttcttcaaatgcgagggccttccgaacatagttaaaggagttgatgttcttcatttctgtcttggtcccaaacttgtcagaaccgattggccgaattgagatgttggtatcaacccgcatggacccttcttccatcttcacgtcagagatccccgtaaattggatccgttgacgcaatgcttccaagtaagccactgcttcttcaggcgaggcaatatctggcttagaaacaatttcgatcagcggtgttccttgccggttcaagtcaacatatgaatacttactggtgtgcgtgttcttaccagcatcttcttcaatgtgcatttctttgataccgatctttttcttcttaccgtttacttcaatttcaatccaaccatcatgagcaattggcgtatctgattgagtaatctggtaagctttcgggttatcaggatagaagtagttcttccgatcaaagtgcatgtggtgggcaatttgagcatgaagagcaagtccagccatgattccgtcacgaacgacacccttatttaaacttggcaatacaccagggtaaccccagtcgatgacattagtgtttgcattaggctggtcaccgtattcaacgggggatggactgtaaatctttgaattagtctttaattcaacgtggacttctagaccgattgttgtttgaaagttcatcttaattttgacctcctaactttggtgtcttcttatggaaatcagttgtctgttcaaagacatatccagtgttataaactgtttgttcgtcaaatgcttttccgatgatttgcagaccaactggcatgccatttttagcagagaagccagcaggaatggacattgcaggaagaccggccatattaacgggaacagtcaatacatcgttcatgtacatagtttgtggatcgtcaatctccgcaccaatcttaaatgccgttgaagcaccagtagcaccaacgattacatcatgatccttaaatacgtcttcaaaatcttgggcaataagacgacgaactttagcggccttattaaagtaggcatcatagaaaccagcagatagagagaatgtccctaacataatccgccgcttaacttcttcaccgaaaccttccgaacgagaacgaacataaacgtcttccaagttcttaacatcagcagctcggaagccataacggataccatcgtaacgttggaggttagaagatgcttcagatgaggctaaaatgtagtaagcaggaaccccatacttggtgtgtggcaaacttacttcatcaacaattgcgccgagggattctaagtggtccaaagcagccttgattacttcttgaacatcttcgtctaagccatcaaagtattcctttggcacagcaatccgtaagcctttaacattcgtattttcgtttaattgggctgcccagtctggaacttctttaagtgaggatgtcatatcccgttcatcatttccactgatgagggcggtcaacaaggcattatccttaacattttgggtcaaccagccgacttggtcaaaacttgaaccaaaggcaatgattccccaccgcgatacacgaccgtatgtaggcttcatcccaacgacaccgttaaaggaagcaggcatccgaatagaaccaccagtatcagtaccaagcgcacctaaaacatctccggccgcaacagcagcagcagaaccaccggaagaaccaccaggaacccgtgtaagatcccatgggttatgagtcgtaaagaatgctgaattttcagtagatgatcccatggcaaattcatcaaggttagtcttaccaacattgatgtaatcagcggcatttaacttttcaacaactgtcgcgtcatatacggggttaaagttttcaagcatcttagaagcagccgtcgttgtaaggcccttagttaaaatattatccttaactgcaagcggaacccctgcagttaattgatcagcactaataccttttgcatcaatctcagctgcccgctttagtgcttggtcctcatttaagctgatgaaggctttaacttgatcttcgttacccttaatgtggtcaaaagtttccttggttaattcagttgcactaattttcttatttaccaagtcatcgtgcaattgactcaagcttgtttggtaaaaatccattattcgccgtcctcactttcgtcaagaattgctggaaccttgatgtagccaccatcagtttcaggagcattgttaagcaaggcttcttgttcgtctttagaactcttaactgccttatcttcacgcattacatttacccgatcggttgctgatgtcattggttcaacgccatcggtatcaaccgcttcgaggtcttcaaacatatcaataatgtttcctagttgagtggtaaacttaccaagttcatccttagggaactcaagcttagcaagttcagcaacgtgttctacttgttgctcagtgattttactggccattctctctacctcttttccagtaatttaaaatctacatatacatttaacaattttagcacagaataggctcctatttcatccatgtagaaataaaaaaggagttatcggttcgcattttctagtaacgaatcgatattctcctttttcacctttaataagaatcaaaaatatgcgactggaagttatcagaaccagcattccgataaacaaccgcctgaatttctgaatcagattgaatcttaatatcaatcggaatcccattaggcaggtacttcttcgctgcccgggtaatatattgggtaaaactagtaatttcactttgactatagaactgagtagtaacagtaatgtgcatccccgacaaagttccattttcatattgtgcttgcgctgtaactccgctcaagttagggaagaaactttgaatctgactcttaaagtttgagaaactatcgtcatcagtttgatcagaactattagttgttgctgcactagcctttggaaggactacattcttataatttaacttccgccagctactaatcgtattaccactattcttgctataagcaaagaatgtaccaccaactaaactatcatctggtgcttgtttgtatagtgcaatcacgatcggaacatttccaacgcctgattttttccgcactcgttgtagaaccttttgtgccgcgatttcaccttgacgacgaacctcactatcactaatcttcttagttaaagttggtcctcctgtcttagtttggtagttgtattcggaatttattccaatcccaatcgtaatcccccgcaatttcatggaattaccactttcttgcatataatcttgttcttcaatttgttgaatatagactgggttaggattactcttctttccttgagcagggtttagcccttcaggattactctttgtttttcggccaagccagttttcaatcgtcccactactaaggtattgaccttcttggaaaatatagctttttgttgaaaagacccgttttgaaacctgagtcaaaccactttcaaagcttttaaggttatattgattatcattttgtgagacatttatacctcgagctttacttgttcggtaacgaccatttttaatcacaccttgataagtaccattacttgaaccagtcgttgaatagtttttcgatgacgactttcctccaaaaccacatgatgcaagcaaaacagtacacatcaaaacggcagcactaacggctattttttttgcctttcgcttcacgatttactgttcctccttcattgcttggctgaattgctgttcattccatacatcaatacccaagttttgagcttttgttagcttactaccagcatcagccccagcaatgacaatatctgttttctttgagacactttcggttaccttagccccgtggttttcaagccatgattttgcttccccacgagtcatttcagttagcttaccagtcagtactactcgccgaccattccattcgctatcaggattagcatttgaccgtgagccaagataagcaaagtttaccccaacttctcgtaattcgtcaattaatttaacaacctgttgattagcaaaataagttacgatactttcgccaattgttggcccaattccactaatcgcagaaatttcatcggcatcagccttcattaagctatcaaggtcaccaaaatgttccatgataattcgagcagcctttgcacctacatgacgaattccaagaccaaataataagcgctcgacagaattattacgactattatcgatcgatgtcaataggttagcggtcgatttctcaccaaatttatctaaagttaataattgatcatgattaagccgatacaaaccggcaacatcatgaattaattctttatcccacagctgttcaataattctaggaccaagcccatcgatattcatggcattccgagaagcgaaatgtgctaagccttctttaatctgtgctggacacattggattaatacagcgtaacgcaacttcaccatcaagatgaactaattccgagccacagaccggacacttcgttggaatctcatattcaactgaatctgcaggacgtttagttagatctacttttgaaatttcaggaataatgtcacccgctttatgcaggtaaacagtatcaccaattcgaatatctttttcacgcaagtaatcaggattatgcaaagaagctcgactaactgttgtacccgccaattgaactgggtccataactgctgttggcgttacattgccggtccgaccgacagtccagacaatatcacggacaatcgttgcttgctcttcgggagggaatttataagcaatttcccagcgtggcaccttaactgtattcccaagggcaacttccgtatcaaggtcgtttactttttcaacaattccatcgatcccgtaagtgagcttgtctcgttgagctgtatattcttcaatatacttctcaatttcatcacggttatgaacaacccgattattaggattaacattaaaacctaattctcgcatacgatcaagtgcttccgcttgggtcttaacgcctatcttttgatattcaggaacataatacataaatgtatctagttcacgctgcgccgttactttcggatctagttgccgcaaacttccggctgctgcattccggggattagcaaaaaccggcaatccttctgcttcgcgtttagcatttaactttgcaaaagccgcttttggcatataacattcgccccgaacctcgatcgataatggttctggcaattctgcgggaactgacttgatagttcggacattagcagtaacatcttcaccaatcgttccattgccacgcgtagaaccttgaactaactttccattctcgtaaacaagtgaaagagaaaggccatcgatttttagttcgagattatattcgggctcaacttcgacatcccgattttcctgttgtcgttggttaaagtccatcaattcttcaatcgaaaagacatcccccatcgataacatcggaatttcgtgccgaacttttgttaattggctttctgttgctcctcctactcgttgggttggcgaatcagcagagaccaattggggaaattgttcttccagctgtactaatcgctgataagcacgatcatacacatgatcctctacagttggattgtcttgttcataatattcttttccccacttagtcaattttgctcgtaatggcttaatctcatcttgagcttcttgaagggttaattcttttactggcgtctgtttttcactcatctcatccgcctcatttcgttatttttgtactttcgtaattggggcaaaacttgccaataaccgttttacaccctgacttggaaaggcaatatctaattccatatcattgccactaccgttaactttgaccactgttccttggccccactttttgtgttcaactttatcgcccgttttccagccaactttatcggccccagttccggtgttagtaattggtttaactcgcttgccagcactgcgatatgtccgcttttgctgatcacggtaggtagtagcggttgcggcagcacgatcaaatggcagtttactatctttaatgctattacctgatgggctattttcaaactgtaacaactcagaatcaatttcctctacaaatcgtgatggttggttacgctggatacgaccataaagtaaccgtgaaaaggcattagtaagataaagctttttctttgcccgtgtaattccaacataggctaagcgacgttcttcttccaattcatcatcttccattaaagctcgggataatgggaaaataccttcttccattcccacaaggaaaacaactggaaattcaagtcccttagctgcatgtaatgtcattaaagttacagctggcgcttgttcatcaacattatcttgatctgagacaagggccaaatcagctaaaaagttaataattttttgcaagttaggatcatcatcgtctttatgctgctcatcatattcttgtgtaaccgacttaaattcatcaaggttttcacgacgagcttgtgcttcaaggcttcgatcattacttagcattttattgtagccacttaactctaaaatctgttcagttaaatcagttaatgtgagatattctgcttgtttagtcaagttagccattaattgaccaaattcatcaattttatttcgtgttcgtgcagtaatttcactagcagtatcaacattttgagctgcctttaatagtgtccagccattttcattagcgaaattgcgaagatgttccacactagttaaaccaattcctcgtttgggcgtattaacaactcgttcaaagctcattgaatcggcaggattaacgattaaggttaaatatgctaaaatatcacgaatttcacgccggtcatagaatttatggccaccaaccatcgtataaggaatactactcttcaagaaagtttcttcaaccatccgtgactgtgcattagtccgataaagaattgcaaagtcattaaagtgatagccatgcttttcttgttcttctttaatctttgaaacaataaactgcgcttcatcatgttcattttgcgcgcggtaatacgaaattttatccccttgaccattttccgtccacagattcttcttttttcgataaaggttattagcaataacttcatttgccgcatttaaaattgtttgcgttgatcgatagttttgttcaagcattaccgtcttggcttggggataatcatgttcaaaattcaaaatattgttcatattagctccacgccaaccataaatactctgatctgcatcccctaccacacacagattttggtacttttgcgctaatagattaactaaccggtattgggcatcgtttgtatcctggtattcgtcaacatggatatagtggaacttatcttgataaaattcaagcgtctcttggtcactttccaataactcaatggtcttcataatcaggtcatcaaaatctaatgcttgattagcttctaactcttgttggtaaagcttatatgcacgcgcgaccatgttttcaaacatactattagcttctttgctataatcatctggcgtcaacaaagcatttttagcattagaaatcgcacttaaaatactgcggggatcaaattttttagtatcaatatttaattctgcgcaaatccgcttcattaacgtccgttgctcacttgtatcagcaatcgtaaaggcgcgattatagccaattttttcaatatcacgacggaggattcgaacacataatgcatgaaaagtcgatacccaaatctcattagcactttcaccaagcaatttaccgacccgctctttcatttcgcgcgcagccttgttggtaaaagtaatcgctaaaatattccatggtaatacaccattttcttcaattaagtaagcaacccggtgcgtaagaacccgtgtctttcctgatccagcaccggccattactaataatggtccctctgtagttaatactgcttcggattgcttatcattcattccttctaataatgcttgcccgttattcacgctgttccatcctctctaaattttcatcggctaatattataccaaattaggatcttatttggtgctaaaatcgaacatatgttaggaaaaataaagagactgcgatttcatccccagtccctcgtaatcttgtacgcttaatttataatttcgtgatcaagcttggtcgttccaaacttcagtatcgtcaacctgattctttaaggctgccaagttatcgccgccagttacccagacaaagcctagaattgcctgatcgtcatccccaacatcattaaagaacctaaattgccagttattcttcaacaaccattgccgttgaattgctcgtgattgataattgcgaacgaccatcaataagccaatttgtaatggcgtaataacatgcaggggcatcccaaccgcacttcttaattgttcttcatactggtcaacatttgccgtgacatcataaatattagcaatcgacgttagccctggttcgatattctttacatagagggtaccagtagaagtaacataaaagttaaccgaaaatacaccccgatactccaaagatgctgcaacactttttacaatccgctgcatctcttttaacatatcatcgtgaatatttgctggtgtcgcaacagaaatcaattgccgcttgtcattgtaatgaagctgagcaagtgggaaaatctctgtatcttttccatcagttgccgctgtcatcgtatattcatttgtatgttcaatccacgattccagtaaatatgtaccagtatcaataaaatcagcggcgcgagtaatatcagattggcgctcaatcagcattgaattttccccaattcctcgttggatgggttttaacagtgcaggatagccgatggaatcaattgattgataaacatcatctaaactaaccaccgtcacatatggggcaatattaatattcacttgatctaggaaagctcgttccattaaccggtcttgaacaatttcaagagcattaatcccctgaggaatcactgcatattgactcaaaaagtgcaggacgcgagaatcgacattaggggtttgataaataattgcatcacatgcttccccaaactgagttagttttgcccgatcattcattgcccctacaattgtaaagtcagccattttagttactgatggctgagaacgatccacatatacaccaacattaaagcctgcctttttcgctgccgcaataagtgcagctccattgcgattaattccaataattcctaaagtactacctgggtaaatagcatctctgcccattttatcacttcccttattagtcttttacgaattcaactttattatcactcaatgattgaattcgtgccaatgattcgacacgaattccacgttcttttagttcgccagctccaggttgaaagctcttttcaataactattcctgcaccggctacttgaacccctgcttgatcagcaatttctaataatccctctactgcttgaccattagccaagaaatcatcaatcattaaaattttatcgtcagcatctacatactttttagaaattgaaatccgattggttgttttcttggtatatgaatatacatcagcagtatacatattttggttaagagtaaggctcttatgcttacgagcaaaaataactgggaggttcatttccaaccctgtcattacagctggcgcaattcctgatgattcaactgtccaaattttagtaataccttcattagcgaaaagtttggcaaatttttgaccgatatgcaacattaattgaggatcaacttgatggttcaaaaaggcatccacttttaaaacattacccggtaaaacagtcccatattccttaattttttcttctagctctttcattttcgtacccctctatattacttatcataattatataatttatatgccttaatcacagaaattaatttttgtgcataatcaggatcagtcgcataccctgcttcttgtaatccacgagctgcttcttgataattagtcgcatgaacaactcgatcgtaattttgttgattggtgtctgtcccatttaacatcaatcgcgtgtgatccttaatagagtcgctccaactatcataaacgcggaaccgccccttagtaacgatccacttaccattaatgtattctttggttgtcattactcgtgaatttgttcctgttcccttaattccaaataaattatggtattgcgacgctaactgactcgttccccattgagattcaagaatcgcttgggcaatcgtaattgatgcatagacatgataagtattttgcattgcctgggcttcaggagcaacttgctgaataaataattgcttcgctcggcgatccttttcacgtgcctcttgttcaattcgttgctgattccaaattcggtaaaaatggtgcccaacgtaaacacccaaaaaaataacaataacagcaagaatgctaataatccaatttctacccgtatggcggtttttgcttctccgcttccgttttgccacaagcctagcctcctcatttctactagttattaattgtagcaaaatccatctcgtttgggttaatttatcgtaatatttttagaagaagttaaaaaagcgcagctgaaaaattcttttccagttgcgcttgctgctactagcattaaatattaatggaattgcattccaccatcaacaataattgtctgtccagtaacgtaatttgaatcaggaccagctaagaaacttaccacattagcaacatcttctggttcagaaagacgcttcattgcaatgttcttggcaaaagtttccattccccattcatcactcttaccagcgttttgaccaacttgatgtgcaatatcatacatcatcggtgtcttaacgattcctggtgcaaaagcatttaccgtaatatcttcagttgccaaatcttgtgctactacttgcgtaatacctcgaatagcaaattttgttccagaataaagtgcaaggttaggattaccaacaacgccagcttgagatgtggcattgataatcttaccaccatgaccaagctccttaaaagccttgtgggcagcctgaattccccataaaaccccagcaacgtttacgccatatactttttcaaattgttcaggtgtaattgaatcaattggagtagtaggacctaagccagcattattaacgattacatcaagatctccaaaatgttcgactgttttctcaacagctgcaaatacttcttctctatttgctacatcggctacaagtggtaatgcttcgccaccattattattaagttcatcagcaacttgttggagctttgcctcgtttaatgctacaagagcaactgcaaaaccatccttaaccaatctttctacaattgctttaccaattccttggcttgctccagttactaatgctacctttttagtcattagtaatccctcctttatactagttatcacttattataccgtatattaaattccgtttaaatataaaaaaagacaccagcaaatactgatgtctctggaagcggtaatcgaaatattaacgcttactgaattgagcagccttacgagctttcttaagacctggcttacgacgttccttcatacgagggtcacgagttaagagaccagccttctttaaagcgtcacggaagtctggatcaacagcgagaagtgcacgggcaataccatgacgtactgcacctgcttgaccagagaatccaccaccattaacgttagctaaaacgtcgtattgaccttctgttttagtaacagcaaatggttggttaacgatagcacgtaagttggcaaatggaatgtagtcttcaattgccttgccgttcatcgtaatcttacctgaacctggtactaagcgaacacgtgcggttgcatccttacgccgaccagtaccactgtattgtacttgttgagccaattccattccctccttagattaagttagtaatgtctaaaacttctgggttttgtgcagcatgtttgtggtcttcaccagcataaacatgtaacttcaaaccttgcttgtgaccaagagaattgtgtggaagcatacccttgatagcagtttccaataacttctctggttcctttgcaaggaagtcaccagcagtccgttgcttcaaaccaccagggtagtttgagtgacggtagtacatcttttgagatgctttcttaccagttaacttaacttgcgcagcgttgataacgataacgtaatcaccagtatcaacgtgtggagtaaatgttggtttgttcttaccgcgcaaaattgatgctactgcagatgctaaacgacccattgggacatccttagcatcgacaacgtaccatttgcgttcaacttcaccaggttttgcgatgtatgtcgttctcacgattaagtcctccaattttgtttttcttttacatataatagtgtaccgagttattagatggaaaagaaataccaatggctagtataccttcttctagcactttcgtcaatccttttcatcatttgttccataatctacattaactaaatataaaccactcgctggcgctgtcatccgtgccaatgtccgatccttcgccttaaggactcgagacacgtcatctactggtcgctgattgctcccgatttctaaaagaaaagcgaccattattcgaacttgattataaaggaaaccattaccagtaaagtcaaagacgacttcatttcttacctcatcgcgtttaattgtaatattctcaatcgtccgaacattactttttgcttgacttcctgatgcaacaaaacttgtaaaatcatgagttccaaccaaatcatcagctgcttttctcattttttctaagttaagaggatatttaaaatgagaagtatagttacgtttaaaaggattcacaaattccccctgatcaacccgataacgataagttttacgatgagcactataacgcgcatgaaagtcattatcaactaattcagctttcttaattaaaatatccagtggcaaaatgctgttgagggcctttctcatcgattcattacttaaatgatagggaatatcaaagtgcgcaacctgattcagagcatgaactcctgcatctgttcttcctgagccgataacgggaatagcaggagttgggtgcttagcaattttatttactgcattctttaatgtttgttcaactgtccgcttatttggttgaatttggaaaccggaaaaattggttccatcataagcaaaggttattttataacgatacattttttacttccttattaatttataaaaatattcggatgcaaactagaccaactgtcacaatcaatagcgccaagccagcccacgcatcatttttatgccaaactaattgacgataatgagtccgtggtgcattaggatcataccctcgtgcttccattgccgttgctaattcttctgcccgcttaaacgagttgacaaacaatgggataagaatcggaactaaatgtttaatccgtgtcaaaagatttccagcgttaaaattaatcccgcgggcccgttgagctttcataattttattagtttcatccataatagttggaacaaagcgcaacgcaatggaaagcattaacgtaatctgattgacagggaccttaattatttgtaatggtttcattaaccatgccaaggcgtctgcaatctgaaaagtttgagtggtggcagttaagacagttgaggcggtgataatcacaataaaacggtagaaaataatcaatgaattaataagaccatcacgggttattgccataattccccaatgccaatacatctttccgccactactaaataaaatttgaaacgctactgttatcaaaataattaaaaataacggcttaattccttgccaatactgtcttaacccaacattacttaacttaattgccgcaaggagcgctaataaaagccatatagcagctaaaaaattattcacgaagaaaattaaaataacgtaaataatacacataattagttttattcgtggatcaagacgatgaaggatcgattttactggtacataactaccaaatacgattttactattcattttcttttctcctcatcgcttctgctatttcatctgctaatgcatcaagcgtaagcggttctgtattttttaaagttatcccatctttactaaggaattgcgcaacttcgacggaaacaggcagcgtcaatgatagtttttttaatcgttgagcatcattaaataattgctgaggagtcgtatccgcaacaacctgcccattactcattgcaattacgtgattagcatagtaggctacctgttccatttggtgagtaaccattataatcgttgttcctttcttattaagttctttaataagtttaagcaaatcattagttgcttgagtatccagtcccgctgttggttcatcaagaattaaaatttggggatccattgctaaaacgccagcaatcgctactcgcctcatttgtcctccagaaagtgcaaaaggagagtgtgactttaattctaatggcaaatccaccatttttaatacttcatcaactgctttttcaattttttttgcaggccaccctaaattatgaggcccaaaagcaatatcctccgcaactgtttctgcaaatagttgctgttcaggaaattggaatacaaaaccgacttgatggtggattttacttaaatattcagcttttgtcgttgcattaatttctaaacctgctacattaagttccccactactgggctttattaatccatcaattaatgaaaccaatgtcgacttcccacttccggtttgtccaataatagcaacaaactcttgctctttaattgttaatgagacattatgtaaggcttcattagtagaattcggatatatatagtggagtttttttactgtaattgctgctttagccaattttttagctcctctaaatttaaatatctatttggaatattaattcctcgttcaaccaataatttctgcagttgctgactcgcaggaactcctactccaatttcaagtaataattctttatctttaagaatttcggatggagtaccttgctttacaacttgcgaatcatttaacacaattattttatctgctagctcaatttctttaagatcatgcgtaatcgaaataattgaaagattatattcattttttaatctttgcaataaagacaaaatttcttgtcgtgctaaaggatcaagcatactagtggcctcatcaaggattattatcttaggcattaatgcaaggattcctgcaagtgctacccgttgcttttgtcctcctgagagattaataggagctgtgtttttataatcactcattcccaccatctttaaagctttatcaatcttttcccccatttcattttgagctacttgtcggttttcaagtccgaatgcaacatcgtcagcaactgttgctcctacaaactgattttcagggttttgaaaaacgaatccgatttgctggtgaatctgacctaaagaactttcgttaacttgaattccgtcaacttcaatcgatcccgcagtaggactgagtaatccatcaattaatcgggctaatgtactctttccgctaccattatgaccaataattgctgtccaagaaaatggttcaaaatctagattgatattgtttaaaacggggtatttactgtctggatatgtaaatacaagctttcgaatttttattccagtcacagtatttcctcttttcaattttagttaataagtatattttagcaaagtccacagaattatctatcaaaattaaatttaaaataaaaaatcacttaccattgaagtgcgcgagggtttcccgcattcaagctagactagggtttccccaccatcgtaacgctctatactatcaatgatagtgattctttattacgtatttagtttatgtgaacgaattaattagtccactaattcaagaataaccattggtgcaccgtcaccacgacgaggcatagtcttcaagatgcgtgtgtaaccaccgttacgatctgcatactttggagcaagttcttcaaaaaggttttgaagagcagattgtacacgaatatcatcgccatcttccttaacatcagcaacaacattacgcacaaaagcggcagccttacgacgagaagctaaatcaccatgcttagcaagcgtaatcatcttatcagcagtcttacgaacttccttagcacgtgcttcagtagtggtaatacgaccattaacgattaaatctgtagttaaatcacgtaataaagccttacgttgtgaacttgtacgtcctaatttacggtaactcataaagtggttccctcctttgcaattggtatactaattagtcgtcttggcgaaatgaaacaccaagatcatttaatttaagtttaatttcttctaacgacttttgtcctaagttccgaaccttcatcatatcagacactgttcgatcagttaattccttaacagtattgataccagctcgcttcaaacaattgtaagaacgtacagagagatcaagctcttcaatagtcatttcaagcatcttctctttgtgtgtttcttctttttcaaccatcacttgagcattttgagctgtttctgttaaatcaacaaacatagctaagtgttcagtcaaaatcttcgcacctagactaactgcttcagttggtgttaatgaaccatcagtccaaacatccagcgtcaacttgtcataatcgttacgctgaccaacccgtgcattttcaacagtgtaatttacacgttcaattggggtatagatggaatcaatcggtaaaacaccaattgctaaatcatccatccgggccttattatcgttagcagaaaggtaaccgcgacccttatcagcagttaacttgatgtgtaattctgcgccatcagcaacagttgcaatatgcagatcaggatttaagattgtaacttcattatcaccctggatatcacttgcagttacttcagcaggtcctttaacatctaattcaagattcttttgatcctcagaatcaagcttcaaagaaactttctttagatttaggataatctgcgtaacatcctcagttacaccttcaacagtgctaaattcatgtaaaacaccatcaatttgcatactcgtaatcgctgcacctggcaaagatgcaattaatacacgtcttaacgagttaccgagagtggttccataaccgcgctcaagtggttctacgacaaatttaccgtagttatctgtttcttcaactttgtgaatatttggcttttcaaattcgatcattctatccttgtacccctttcaaaacgtggttcgtatttgagacaaaaaggcaattgatggaaataattgtctccagcaatgtcaattaaacacgacgacgctttggaggacgagaaccattgtgaggaacaggtgttacatcacgaatagcagtaacttccaatccggttgcttgaagtgcacggatagcagcttcacgacctgaacctggacccttaacttcaacttcaacagtcttcataccatgttccatagcttgcttagcagcagcttctgaagccatttgagcagcaaatggagtggacttccgacttcccttaaagcctaaaacaccagctgaggaccatgctacagcgttaccttgaacgtcagtaatcatgatcaaagtgttattaaatgttgagtgaatgtgtgcaacaccagtttcaacattcttttttgcacgacgcttacgcgtaccttttttggttgccatatctagtactaacctccttttttataaagttaaattacttcttcttattagcgatagctacagctttacccttacgagtacgagcattgttcttagtatgttgaccacgaacaggtaggccacgacggtgacgcataccacggtatgatccaatttcttgaagacgcttgatgttcattgaaacttcacgccgtaaatcaccttcaacttgaatttgatctacttgtgcacgaattttttcttcttgatctggagtcaaatcacgaacacggatatcttctgatacaccagcattttcaagaatcttcttagcagtagaatcaccaataccaaaaatatatgttaagccgattacgattcgcttgtcacgaggtaaatcgacacctgcaatacgagccatgagctacacctccatttctctataaaataaattacttaccttgacgttgcttatgctttgggttagcagagcaaataaccataacacgaccattacgcttaacgatcttgcagtgctcacacatctttttaacagatggtcttactttcattctaaaatcctcctattgagagtaaatgatcaataactacttgaaccggaaagtaatccgaccctttgtaaggtcatatggagacatttctactttaacacggtctcctggtaaaattttaatgtagtgcatccgaattttgccagaaacatgtgctaaaatttctgctccattttccaattcaactttaaacattgcgttaggcaaagtttcagttactttaccttctacttcaattacatcggcttttgccacgaaatagtacctccttacctattctagatattacgtaaaaatggtggaaagtataaaacttcccactactcagatagataaaccttgcatagtttagcatatgtttacaaacttcgcaagagataactattatctagtttaggtttgttaatactttcttgatatcttcataaactttatcgatatcttgttcaccattaatttcgtgcaaaacacctttcttttggtaatagtctaccagtggtgtgttcaacttaatattaacatctagacgattcttaaccgtttcaggcttatcatcatcacgctgataaaattcatgatgaccacaaacgtcacatgtgccttcaactttaggagcattataaagtttgtgatatgttgctccacagttacgacaaataaaacgtccacttaaacgttctaccaatacatccggttcaacgtgaatattgatcacagcatcaagatgccgattactctctgctaacatctcatccaaagctgctgcttggttaagattacgaggaaatccatccagcataaagccatctttagtatcatcttgagctaaccgttccttaacgataccgttagtaacttcgtccggaacaagttcacctttatcaatatatttcttagcttcaattcccatgggagtttcattcttcatggctgcccgaaaaatatctccagttgagatatgaggaattggaaaattttcaacgatcttttgagcttgagtacctttaccggcacctggaagacccattaatacaagattcatactcattagtcatttcctcctttaggttctcgaataaatccaatatattcgcgcttcattgttagtccgtttaactgtcgaacaacatctaaagcaatttgtacgataatcagtaagcttgtaccacctaaaccaattgactgacttaggttccatacgttacttgcaattaacggaattaaggagattaatcctaagaataatgaacctactgtactcaatcgcattaacaatgaagaaatatagtcttgtgtaccctttccaggacgtactccagaaatataacttccttgcttttgtaaattctcagcaagtttttctgggttaacctgaacaaaggcatagaaaaaggtaaatacaacaatcaaaaatacatacagtgcgatcccaggaccagattgcatgttaaaaatggtcgtcatgatttgataccaactatccccaccatggttttgctggaaagccataagaatagtttgcggggttgagataaaagaaccagcaaaaataacaggaataacacctgatacgttaatcttcaagggaagataactactggatggtgaagtagtggtccgtcttgtgtattgaattggtagacgtctttccgcctgttggacccatgtgacaaacgctacaataattaaaattgcaacaataacaagagtaacaaatccaattcccatccacaaagcagaaccagattcaccagcaatttggtcatcccataactgacgaattccacctggcatttgcgcaacaataccagcaaaaattaacatggaaacaccattacccaagccacgttcagtaatcatgtctcccatccaagtagcaaacattgtacctgcagttaaaattaaaccgattgttaaatacgtttgaacaccagggtgattaaccaaacgaatagtactcaatgcattaaacccggcggtaataccgattgattgaataaatccaagtacaatcgttaaccatcgggttgcttgattaagttttcgccgtcctacttctccttgtttactccattcaacaaaacgcggaacaatatccatttgtaatagttgaacaacaatttgcgcagtaatatatggagacactcccattgcaaataaagagtaattctccaatccaccaccactaaaggtattgaggattgatgctaaaccggttgaggagatttcctgcaaagcagcagcgttaactccaggaacggtaatcgctgccccaatccgatagacaatcaatacaaacaatgtaaagaaaatctttttacggatatcttttaccttgaatgcatttttgacggctgtgaacaaactacatcacctcagttttaccaccggcagcttcaattgcagaaactgcagaagcagaaaacttattagccttaacagttaatttcttttcaagcttaccgctaccaagaaccttgatgccgctcttcaagttcttaactaagccactttccatcaataattgtggagtaacttctgtaccatcatcaaacttgtttaatgatgccaagttaacaatcgcgtattctttccggttaatgttggtaaatccacgctttggaatttgccggtaaagtggcatttgacccccttcaaatcctaaacgggtctttccatgagccttttgccccttagtaccacgtccagatgtaaaaccgtgtcctgatgaaagtccacgacccttacgaagacgcttagaacgagaaccagtagctggcttcaattcgtttaacttcattagtaggcacctccttattatttaattttaattacttaacttcttcaacagaaaccaagtgagcgatcttaaaaatttgaccgcgtgttgccgcattatctggtaagataactgagctattgatcttacctaatcccaatgccttaacagtacgacgttgagtaggttgtcggtgggcaacactgtgaattaaggtaacttttacttgagccataatttagtgccctccttattctgctaagtggtctactgaaacaccacgtaactttgcaacttcttcagcgttctttaattgcttcaaaccttcaaacgttgcacgaacaacgttaacaggtgtgttagagccaagacgtttagaagtaacgtccgcaacaccggcaaggtccataacattacgaaccgcaccaccggcagcaactccagaaccttcaacagctggctttaacatgatctttccaccgccgtatacaccaataacttcgtgtggaatagtagttccaacgataggaacagtaatcaagttcttttcagcagctgcttgagctttacgaatagcttctggaacttcttgagccttaccagtaccaaagccaacatgacctttacggtcaccaacaattactaaagcagcgaaacgcatacgacgtccaccctttacaaccttagtaatccggttgatggctacaacttgatcgtctaaatccaactttgctggatcaatgaattctgatgatgccattgcaggttattcctcctttttttagaatttaagtccgttttcgcgagcagcttcagccaaagcttgaacacgtccatggtaaaggtatccgccacgatcaaacacaacttcagtaatgttcttttcgttagcgcgtttagcaattaatgctcctacaccactagcttgttcagtcttagtctttccacttacttcactatcatttgtggaggcacttgcgagcgtcacaccctttacgtcatcaattaattgagcgtaaatgtttttgtttgaacggtaaacacttaagcgtgggcgctccgcagtaccagaaatcttaccgcgaactcgtaaatgacgacgttgacggatcttgttcttgtctggtttagaaatcacaacagtcacctcttattatattaattctattaaataaaagaatgttaaataatcttttcagattacttaccagtcttaccttccttacggataatgtgttcgttttcgtaacgaatacccttacctttgtatggttcaggtgaacgtacagcacgaacttcagcagcaaaatttccaaggtgttccttgttaattgagcttaattcgatagtagtattgtcaggtacattaatttcaacatcttctggcttatccatttcaactgggtttgagtaaccaacagttaaaatcaacttgttacctttgagttgagcacggtaaccaacaccaacaagcttaagaactttcttgtaaccatcaacaacaccttcaaccatgttgttaacattagcacgagtagttccgtgtaacatctttaacttattagtgtcagcatcacgatcaaactttacaacgttaccatcaatagtcattttgattaatggtgaaatttcacgagataacgtacccttaggacctttaacagtaactacattaccatcttgagaaatttcaacaccacttggcaaatcaatttctttgtaaccaatacgactcatctttgcacctcctatctaatattcgttttttaccaaacgtaagcgataacttcgccaccaattttcttggcacgagcaactttatcagtaacaacaccttcagatgttgaaatgatagcaatacctaatccgttaagaaccttaggcacagcatctgacttaacgtatgtacgtaaaccaggcttagaaatacgctttaagccagaaataacacgttgaccgtcattaccgtactttaagaacacacggatgatgccttgcttgttatcatcaacgtattcaacatcgcgaatgaaaccttcgttttttaagatttcagcgatgtccttcttcatctttgatgcaggtgcttctactgattcgtgttgagccatgttagcattacgaatacgagttaagaaatctgcaattggatcactcatagacatcgatgttttcctccttttgtcggtttttttgtttaccagctagccttcttcaaaccaggaatttgtcctttgtgggcaagttctcgtaagcaaatccggcataggtggaatttacggtaaacagagtgcggacgtccacaacgtgcacaacgcgtgtattcacgacttgagaacttagctggacggttgcacttagcaatcattgattttttagccaatttgtggaacctcctttatttagcaaacggcataccgagttgagcaagtaattcacgggattcttcgtcagtttgtgcagttgttacaataacaacatctaaaccacgaactcggttaactttatcataatcaatttctgggaaaattaattgttcatggataccaagagtgtagttaccacgaccatcaaatgccttgttacttacaccatgaaaatcacgaacccgtggcaatgccacattaactaatttatctaagaaatcatacatacgttcaccacgtaaggttaccttagcaccaattgacataccttcacgaagacggaaaccagcgattgatttctttgccttagtaattaaaggtttttgaccagaaatcaagccgagttcttcaacagcttcgtcaagattcttggagttagtagttgcatcaccaacacccatgtttaaaacgattttgtcaatctttggtgcttgcataactgaagagtagttaaacttttcaatcaatgctggacgaatttcattttcgtatttagctttcaaacggttttccattagaagttattcctcccttccttaaaaattagtcaagtgtcttacctgacttcttcgcaacacgaaccttcttaccatcaacgaacttataacctacacgagttggttcatttgttgaaggatcaatcagcattacgtttgaagcattaattgcagcttctgtatcaataacgccaccattaggatttgagttgcttggtttttggtgtttcttaacgatatttacaccttcaacgataacgcggttttgagaagcaagtacctttttaatagtaccttctttgcccttatccttaccagcgattacgcgaaccttatcacctgttttaatgaacatgttgattgtgcacctccttattttcggtaaaatctttagagaacttctggagctaatgaaacgatcttcatgaagtcgtctccacgaagctcacgagcgattgggccaaaaatacgggtacccttagggctcttgtcgttgttaattaaaacagcggcattttcatcaaacttaatgtatgaaccatccttacggtgaataccatgtttagtccgtacaacaacggccttaacaacgtcaccctttttgacaacgccacctggtgttgcctgctttacagtagcaacaatgatgtcaccaatattacctgttttaactcgggaaccacctaaaatcttaataactaagatttcacgagcaccggagttatcagcgaccttcaaccgactttcttgttgaatcacggttaatgtcctccttccatttacaaataagaattagaatacgaataatttttagagttatctgctaaattaaagggtagcagctttttcgacaatctttacaagacggaaacgcttcttagctgataatggccgagtttccataatttgtacagtgtcgccggtcttagcttcgttgttttcatcgtgagcatagtacttctttgagtacttaacacgcttaccatagataggtgcactcttgtaagtatcaattacaacagtgatagtcttatccattttatcagaaacaacgtggccttggtaaaccttacgtgcattacgttcttcactcatgcgctaatcctccttttcgtattcttatttgtttaattcttgttgacgaagaactgtcttaacccgtgcaatatctttgcgtacttgcttaagacttgcagtattttccaactggccggttgctaattggaaacgtaagttaaacaattgttccttcagttccttttcacggtcaagtagcttatcagtggttaatccattcagttcttgtacataatctttacttttcattagattgtccacctacttcctcacgttgtacgatcttagtgcgaactggcaacttgtgaccggcaagacgtaaagcttcacgagcgacttcttcagaaacgccccctacttcaaacattaccttgccacgttttactggagcaacccatccttcaggagcacctttaccgttacccatccggaccccaacacccttactagtgtatgagagttgtgggaagattttaatccaaactttcccaccacgcttcatataacgcgtcatagcgatacgagcagcttcaatttgacggttgctaatccaatgtgaatcaagagcttgtaaaccaaattcaccaaaagtaacagttttaccacccttagcttcaccgcgcatatgaccacgttgaaccttacggtgctttacacgttttggtactaacatgtgttacttccctccttgttcatcattgtttgagttcttcttagtaggaagtacttcaccacggtaaatccaagtctttacaccaagaacaccgtatgtagtgttagcttcgtcccaagaataatcgatatcagcacggagtgtatgcaatggaacagtaccatccgagtatgattcgatccgtgacatatctgcaccgttcaaacgaccagcaacttgagtcttaatacccttagctccagcacgcatagcacgttgcatagctccacgcatagcacgacggaaagcaatacgagcttctaattgccgtgcaatactctcaccaacaaggtgagcatctaaatctggcttcttaatttccacaatgttaatgtgaacacgtttaccagttaatttgttaagttctttacgaagtgcttcaacttctgaaccacctttaccaataaccattcctggcttggcagtatgaattgatacgtttacgcggttagctgcacgttcaatttcaacggttgatacagaggcatcagcaagtcgcttttcaatatacttacggattcgaaggtcttcgttaaggtaatcagcaaagtccttgtcagcgtaccactttgcagtccaatcacgaatgaccccaacacgaaaaccattaggattgatcttttgacccactattcattcctcctatcgttctgtaacaaccactgtaatatgactagtccgcttgttaattggagaagcagaacccttagcgcgaggacggaaccgtttaagagttggtccttcgttagcaaaggcttcacttacaaccaatgaagcgcgatctaagtcgaaattgttttcagcgtttgcaacagcagattttaatactttttcaacatctgaagcggcaccacgaggggtgaacttcaaaatagcaaatgcttcggcaacactcttgccacgaatggcatctaatacaagacgaaccttacgagcagaaacccgtaccatcttggcagtagccttagctgacgtaatgttttcagccatatgttatttcaccctccttacttacctgtcttcttgtcatcagaagcatgaccatggaaagtccgagtaggaacaaattcacctaacttgtgaccaaccatgtcttcttgtacgtaaactggcacgtgcttccgaccatcatatactgcaaatgtgtaaccaataaaacttgggaaaatggtagaacgacgtgaccatgtcttgatgacagtcttcttttcagaaccttcttgctccttaaccttcttcagtaatgaagcatcagcgaaaggtccttttttcaaactacgacccatttagtgtacctcctctcgggtattagaacgtatataaatattaacgagtatgtggaccgcgcttccgaccacgaacaatgaacttgtttgaacgagctttgtgtgaacgggtcttcttaccaacagtcttcttaccccatggagaaagaggagatggtaaaccaactggttgcttaccttcaccaccaccatgtgggtgatcgttagggttcataacagaaccacgaacgtgtggacgttgaccagcataacgagtacgaccagccttacctttaataatcaaggcgtgttcatcattaccaacagtaccgatagtagcacgacaagtagcaaggaccatacgaacttcaccagaagaaagacgtactaatacgtatttttcttccttaccaagtaattgagctgaggcaccagccgaacgagcaagttgaccacctttacctggttttaattcaatattgtgaataacagtaccaactggaatgttctttaaaggaagagcattaccaaccttgatatcagcatcaggaccagattgaacggtcatgccaaccttcaagcccttaggtgcgatgatgtatgatttagtaccatcagcgtaaacaagtaaagcaatatttgcagtacgatttggatcgtattcaattgccttaacagttgctggaacatcatctttaattcgcttaaagtcaataatacggtattgacgctttgtaccaccaccacggtgacgaacagtaatgtgaccatagctgttacgaccagcagtgtgctttaacggagccaataatgacttttcaggtgttgtcttcgtgatttcagcgaagtcataaccgttcatattacggcgaccgttagtggttgctttatatttacgaattcccactgttttttcctcctttttttaatgattagttttcgttgttgtcgttaaacaacttaatttcatttgagtcggcagataaagtaacaatagccttacgacgacgcttagtgtatccttcgtaacgaccttggcgctttaacttaccttttacattcataatgttaacttttacaactttaacgccaaaaatttcttcaacagcatttttaacttgtgtcttagttgctcgtaaatcaacatcaaaagtgtaacgcttgttgtccatgccagccattgaagcttcagtaactactggacgtaaaataatgtcacgtgcttccattatgcgagcacctcctctacttgagaaagagctgacttagtgataacaatcttttggttatcaacaacgttcaagatgttaacacctgctggagtaacaactgtagcattagctaagttacgtgctgataaagcagcattcttgtcgtcatcagtaacaacaactaatgtcttttcagcaacgtttaagttacccataacatcagcgaattcctttgtctttggtgcatcaaaatttaatgcatcaactactacaaagctgttatcaagaaccttttgggaaagggcagacttgattgcaagttgacgaaccttacgaggaaggctgtacttatatgaacgtggagtaggtccaaaaacaataccaccaccacggaattgtggagaacggatagaaccttgacgagcacgaccagtacccttttgacgccatggcttcttaccaccaccgctaactgcagaacgattctttacagcatgtgtaccttgacgtaatgaagcacgttgacgcaaaattgcatcaaatacaacattttcatttggttcaaccccaaatactgcatcgtttaattcaacagtaccgttttggctaccatcttgtttatacaaattaacgctagtcattatttacttcctcctttcttcttatttattgtgttgtttgctaagactcttcttagtattagccttaactgagttcttaatagttacgtaagacttgtttgcaccaggaacattacccttgatgagtaatacattgttgtcaagatcaaccttaacaacttgtaagtgttgcatggtaacagtcttgccacccatacgaccaggaagcttcatacccttgaaaacccggttgataatggcacccaatgaaccaggacgacggtggtaacgagaaccgtgtgccataggtccacgagattggttatctttatggatgttaccttggtaaccatgacccttggtagtacccgtaacgtcgacagtttcaccttctgcgaaaacgtcagccttaacttcgtctccgactttaatgtcccctaattcagcgtcgcggatttcaccgatgaagcgcttaggggtcgtgtttgcttttgctgcatgaccttgttcaggtttgttgctcaaaacttcccgcttgtcatcaaaaccaagttgtacagcactgtaaccatcgttttcaacggtcttaatttgcattacaacgtttggtgtaacatcgataacagtaactggaactaattcaccattgtcagtgaatacttgagtcattccaacctttttacctaagattcctttggtcatgagtacacctccaattttatgttttatgtattattcttattctaacaattaaagcttaatttcaatatcaacaccactaggaagatcgagcttcattaatgaatcaacggtcttaggtgttgggtcaacaatatcgattaaacgcttgtgtgtgcgcatttcgaattgctcccgtgacttcttaaatttgtgtggtgaacggataacagtgtagatagtccgttcagttggtaacggaataggacctgaaatttgagcacctgtccgcttagcggtttcaacaatcttatcagcagattgatctaaaatacggtgttcataagcctttaaccgaatacgaatcttttgttttgccattatgttccctccttcgtcagatttgaaatttgactagctccgcggaaattaccgccacatcctgtggcaaagcggccgggtgtgtcgcaaccttccgcatcaacgcttcgcagctttcacttaatagggggtaaggcaaatctacctccaaagctcaagcacctatccataatactaaagaaacgtaattagatcaagggaaattttagaatattttcaattgaaatatttttgtaaaattttcttcctaagttagttaaaaattagtgatactaaaataccattaatttttctgatgtattaaaaagtaatttattcgttttgccgaaactcattaaaatgctttttgaatttttattaccaaacaaaaaagggttctacgtcaagtagtgttgatacgcaaatataaatctctgccaattaaattggtctagttagaatcgtcattcgtggcggttctttttagttagtttgaatttggtggccaataattaaataaatccgagttttaaatgccgtaaagtagcgataaccacaggcaactcgtttgatagttttaattcgattattaatcccttcggttcgaccatttgagaacttcgtctcaaagccacgcttgattccctctttatagcgctaaaacctgacaacggtggattgtataatggctgacactgtctggccgaagtttaagtaattgaaagaaagttgtaaaatcaacgttgattgtaggcacgcttcaaggattgaataaaattataggtagcgcctaactcttggtcatacgctaacattaaatccaagatcataacagaattaacaacgctgctaaaatagcgtccttcgtaatacaattttgtacttaaattttcccaatcttggaggaataagcgccaatagtgtttaagacgccgcgcttgtttctgctccgctgaatcacctttgcgtaaacggttgaagacatgaattcgcacatgattcatcgtgtcattaagatgtttagcgatatggaaacgatcatagatgatttgcgcacaaggaaaaacagtcttaactagttgatcataagcagcgttcatatccatcaccagatatttcacccggcaacgagcttgacgagtaaactgttgataatgtttaaataagctacgtaatcgacggtcttcaagaggctcaaataagcaacttcgatcaccatcaacggcgatgaaactcatcttacctttagcactccgcattgacttaaattcatcaatacatagcgtttccggtagatagtttaaattcggtttatattgatcggcgaggtccaaaaggatccgctgaactgaagcctcactgataaataaatcatgggcaatatctttaattgtttgaattcgagttaatcgaagaataacttcacgccttaaatcacgactaattgtccgttgcttttcaaagagataactagtcgcattaaatgttgtatgacagtcaggacattgaaaccgttgggtcttaacgagtaacaccaatggctgagtcctaaattgaccatatttgtgtttagcttgataaaacccatattttaagatttgaccgcgattaataactccgcagtttggacaagctcgcggcgtataagaaagggtacaggatatttgcgccacacgaacatttttaattactttatatttaagccaatgatgaggaaaatttaagtgagggtctgttaaattaaggagagttcttgtatcattatccatggaggttaccttcttttctatgtgatttggcgatttcattgtatcagagggcgagcctcttttttagtttaaaaacaaaaaatctgatattggtatagaatgtaatatttctatatcaacaccagatattgtagaacccaaaaaagaactacagtaatcaaactgtagctctttgatggatttgagatcataatgtcaataattagttattgccaccgtttttcttaataatatcttcttgaacagacttaggaacagctgagtagtgatcgaaagtcatagtgaaggtaccacgaccttgtgttgctgaacgcaatgcagtagcgtatccaaacatttcagaaagtggaacaaatgagtggattaattgagcattaccacgttcttccataccatcaatggtaccacgacgagctgttacttgccccataacatcacccatgttgtcttgtggtacaacaatgtcaaccttcataattggttcaaggataacaggatctgctttcttagcagcattcttaagtgctaatgatgcagcaaccttaaaggcagcttcactagagtcaacttcgtggtaactaccatcataaagcttagcatgcatgtcaacaagtgggtaacctgcaagaacaccattttgcatagcttctttcaaaccttgttcaacagcagggataaattcacgaggaacaacaccaccaacgatggcatcttcaaattcgaatccttccccttctttaagtggtgtaaattcgatccatacatcaccgtattgacctttaccaccagattgacgaacaaacttaccttgagcacttgcagtcttagtaaatgcttcacggtatgaaacttgtggcttaccaacagtaacttcagcgtggaattcccgacgaagacgttcaacaataatgtccaagtgaagctcacccataccggcaattaaagtttcaccagtttcaggattagtttcagccttgaatgttggatcttcttcagcaagcttttgaaggcccttgtccatcttatcttggtccgccttagacttaggttctacagaaacttggataacaggttctgggaagtccattgattcaagttgaagtggatggtcaggatcagttaatgaatcaccagtagtagtgttcttcaaaccaatagcagcagcaatatcaccagagaatacttctggaatttcttgttgttggttagagtgcatttgaagcaaacgaccgatacgttcacgcttgtccttagtagcattaagaacgtatgaacctgattgaagtgaaccagtgtaaacacgtaagaatgtcaaacgaccaacgaatgggtcagtagcaatcttaaatgctaaggcagcaaatggcttatcatcaccagctgttaattcaatttcatttccatcagcatcatgagcaacgaatggcttaacatcaattggtgatggaagataatcaataacagcatcaagcatcatttgaatacctttatccttgtaagctgaaccagctaatacagggaaaatttgttcttccaaagtacctttacgaatagctgctttgatttcatcaacagaaatttcttcaccttcaaggtacttttccattaagttatcgtcaatatcagctaatgtttcaaccatttcgtcatgacgcttttgagcttcttccttcatatcatcaggaatctcaacagtatcccagttagtaccgagcttatcttcgtcataaacataggcaaccatcttaacaaggtcaactaaaccgataaagtcatcttcagcaccaattggcatttgaataggaagaggagtaacattcaaacggtctttaatagtttgaactgagtaatcaaagttagcaccaatcttatccatcttgttcgcaaaaacgatccgtggaacgttaaattggtcagcttgacgccaaacagtttctgtttgtggttcaacaccagcttgagcatcaagaactgttacagcaccatcaagaacacgtaatgcacgttcaacttcgacagtaaagtccacgtgtcctggagtatcaatgatgttgatccggttatctttccaaacagcagtagtagctgctgacgtgatagtaataccacgttccttttcttcatccatccagtccatttgtgaagcaccatcatgggtttcaccaattttgtgaatcttaccagtataatatagaatccgctcagttgcagtcgtcttaccggcatcaatatgtgccatgataccgatgttacgagtcttagcaagtgggtattcacgtttattagccatcttaaaagagtatctccttccgaaatatggttatccttattttaccattattttcaaaaaggggtgacgtaatcgatgtttgaacgtcaccccttcactgaaactagttaaataaccagaatcaaatgacagtgattattaccagcggtagtgtgcgaatgcacggttggcttctgccatacggtgcgtatcttcacgctttttaactgaagctccagtattgtttgaagcatcgatgatttcacgtgcaagacgttcaaccattgtatgttcaccgcgcaaacgtgcgtattgaacaatccaacgaagacctaatgtagtacgacggtctggacgaacttcaatcggaacttggtagttagaaccaccaacacgacgagccttaacttccaagacaggcataacattttccattgcttgttggaatacttcaactggatcattaccagtttcgttcttaatttcatcaaaagcagcgtataaaatcttagtagcagttccacgcttaccatcaatcattaagtgatcaattaagctagtaaccaactttgagttgtacattggatctggtaaaatttcacgcttttgtacatgtcctttacgtggcattacttaactcctccttaaaattacttcttattcttaggcttcttagcaccgtacttagaacgtgattgcatacggccttcaacaccagcagtatctagagtaccacggatgatgtggtaacgaaccccaggtaaatccttaacacgaccaccacgaattaaaacaactgagtgttcttggaggttgtgtccaataccaggaatgtaagcagtaacttcgattaagtttgaaagacgtacacgggcatacttccgtaaagctgagttaggcttcttaggagtcatagtacccacacgagtagcaactccacgtttttgtggtgatggagtcttaatttcttctttcttgaaagtgttgtaaacataaccaagagctggtgactttgacttgcccttgtggctcttacggcctttacgtaccaattggttaatggttggcattattttttccccttccttaatttaagtccacacatccaggcggttcttttttgtgaataaaaaaagtcctaaatgtatctatacaatttttgtgccttcgttgacgcatctgcccaacgacagacactccgttgctaaaaaagcaccttaaatagactatcatgctcacaaatgaatgtcaacgtatcctcagcgatttcttttaaatcgttaatttaaaagtgaatttcattaaaaatcacgtatttatttattgggaggttttttatgttatttttatcatttttatttggtgcttctgttgcttcatttattacttcttgttgctatcgtcttggtaataaccactctttaaccattcctcagcgatcatattgtgataattgccattctattttacgatggtggcatcttatccctatttttagttttatcatccttcgcggtcaatgttattattgtaaacaaaaaattagtttatatttgccagtaattgaatttttatctggtattgcttttactactttcctcatttatgaacctattcatgacttaatcattcttctctttctcactagcttaatctttttaacttctactgatttttttagtcatgtaatctattcttattcactattgggaatgtttccgattaccttactatctattccacaaaattatttttacaatttgatttttgcctgcattctagtagtcagtttactattatttgctacttttactaagacactaggaattggcgatattgaatttttgtttgtaacatgcctgatatggggatggtatcaaacccttttaattatccaatggagctctttaatcatgctatttatctttgtatttacaagaaaaaagaaactaccatttatccccgctctatcccttgttactattctgtgtctttttatacaaggctgttaaaaataaaagaccaggattaccctagtcttttacaatgtttaattagtatcatcttttaccggtttgagttttactacaaataagttttgcccaaattgagcgagattttcaatattttgtagtaataaaagcaaccaagaaaaggccaagccaaattcaaacaattcgaatgctgttaaggaaagatagttcgttaacttaaaaacaatatattcgatactcattacggctccaatcgtataagaaatcaccaaaaattgtttagtaacttcaggtagaacccacctaataactacaatcagaattagcataatataaacaagccacattgaaattcggtcatgtaaaacatgaaattctggattattgggaaaaagaccaatagaagcgatacagatagctaacataattaacagccaccgcaatacttgaattttataaccgtgataccgacgttgaatatttacaaataagtaatcaactaaagcaatcattaacaatccggtaaaaatcaaagttatattaaattgcagacttgtggaatttttcgctgttcctaaaaaactgaaattataacgccaccagtctcgtttagaattcgtcaacatcgaaaaaagcattccaccaataatcattattgttaataaattggtgataactcctgatgataatgttaacgctaaattaatcataatatagtttatcgccgcaataattacaaatataaaagcagttgcggtataaatatcaaaccgcgcatccttaaacatctgaccgaacagccaaaaaattgccgatagcgaaaatgtaatgattaggccgcatgcaatcgtaattgttggcaaactccgccaatgaaaatccttgctaggcccttttccgagaattttagtaataataaaagttatcaaaaacgatagaattccactacatactcctaagattaatgcaccattagcaatggaataatcatcacctgttatcgggaccgtgttaatttttctagcgctaaaaaaagctaaaaatattgcagctaaaataattgaaggaatcacataccagaaaatgttaattttaggtagttgatcactcacatttattggacggatgttaatttgtttatgattaacactaagagagagctcttcgttcatagagaagtctgtctttttaaatgctgagtcaggaatttctatctgatatttttttgccaagtaatcacctcattttaaactaaaaaggcaatggccctttcacaggttaaccattgccttttttataaattagttttgcttatcttcttcttttaacttagcctcaatatctttaattgagtaagcagctacactaacttcttttggcttgatattccggtaagcactcataccagtacctgcaggaataatcttaccaataataacattttctttcaatccaactaatggatcgttcttaccacgaatagcagcatcagttaatacacgtgtagtttcttggaatgaagcagctgacaagaaactgtttgtctctaaggcagccttagtaataccaagaataacaggacgagctgttgcaggaatattaccagcaactaaggtatccttgttagcgtcacggaattgactaatatccattaattgacccggtagaaggtcggtatcacctggatccatgacacgaactttccgcatcatttgacgaatcataatttcaacgtgcttatctaacaagtcaataccctgcatccggtaaacaccttgaacttgcgataagaggtaagtttcagtagaaagaacatcacgaacttggattaattccttaggatcaatcgaaccttcatttagtggtgccccacggtgaataaaatcaccttcagcaactttcatccgtgctgtaattggaagagtgtaagttcgggtatcagtctcacccttaatcgtaatatccttcgtccgttcagcagggttttcttcgatagacacaacttcaccagtaacctctgtaattgttgcacgacctttaggattacgtgcttcaacaatttcttggatacgtggaagaccttgagtaatatcatcgttaccagcaaccccaccagtgtggaagttacgaagagttaactgagtacctggttcaccaattgattgagcggcaacagttccgacggcttcaccagcttctacacggtcaccagtagctgcgtttcgtccataacaacgttcacatacaccatgttcagtgttacaagtaaatgctgaacgaatagttactttctttacgccggcatcaacaatcttttgagccatttcttcgtcaataaggacattcttaccaacaatcttttcaccagttttaggatcaaagacagacttcatagtgtaacgacccatgattcgatcataaagcggttcaatcatttcgttaccgtttgtaatagcagtaacttcaagtccgcgatcagtaccacagtctttttcacgaacaaccacatcttgcgcaacatcaacaagacgacgagttaagtaacctgagttggcagtcttcaaggctgtatcagtcatacctttacgagcaccgtgtgatgaaataaacatttccaacactgaaagtccttcatagaagtttgacttaacaggcaattccataatcttaccgtttggtgatgccatcaatccacgcattccagctaactgagtaaagtttgaaatgttaccccgcgcaccagagtcggacatcatgttaattgggttatggatatccatgtgttcaattaacttgttttgaacctcatccttagcatcgttccatgcaccgattactcgttcataacgttcgtcgtctgtaattaaaccacgacggaattgcttagtaattaaagtaacttgcttttgtgccttatcaagaatttctggtttttctggtaaatcatgaatatcagacatggcagtagttaaaccagaaatagttgattcgtagtaacctaagtccttaatacggtctaagaattgggacgtctttgtaactttgtaacgcttatatacttcagcgatcaagtcagataggaagcccttcttaaatggtggaactaatggtgcattttcaaggtattcatggatatcttgaccaggttcaaggaagaaacgatcgtcaacaccattttgaatatttgcatctgttggttcgttaatgtaagcaaaatcttttggcataattcggttgaaaagaagcttaccaacagttgtcaccatgatcttgcctcgttggtcatcagtgaatggcttttcagggaatgcagatacttgaactccaacacgggtttgtaatgaaacatagtcattgcggtaagcaagttcagcttcatcagtatccttgaagatcattccttcaccttcacgacccttatcttcagtagtcatgtagtagttaccaataaccatatcctgtgatggtgaaacaataggttctccgtcacgaggactaagaatatggtgagcagcaagcattaacaaacgggcttccgcttgagcttcatcagataatggaacgtgaatagccatctggtccccatcaaagtcagcgttatatgctgaacatactaatgggtgaagacgcattgacttaccagaaaccaagattggttcaaacgcttggatacctaaccggtgaagagtaggggcccggttcaatagaactgggtgttccttaataacgtcttccaatacatcaaagacatcatcatcactgcgatcaatcttacgcttagcagatttaacgttagcggaaagaccacgctttaccaattcatgcataataaatggcttaaataattcaagtgccattggaactggtaatcccatttggttcaacttcaatgatggaccaacatcaataacggaacggccagagtagtcaacacgcttaccaagcaagttttgacggaaacgtccttgcttacctttaagtaagtgagaaagtgacttcaatggacggttacctggtccagctactggacgtccgcggcgaccattatcgattaatgcatcaacagcttcttgaagcatccgtttttcattttgaacaataattccaggtgcttgtaatttaagaagtcgcttcaaccggttattacggttaataacccgccgatataaatcgttcaaatcggaggtagcaaaacgtcccccttcaagttgaaccattggccgcaagtcaggtggcataactggaattacatccataaccatccattcaggcttatttcctgacttaatgaaagcttcaagaatatcaagacgacgaatagcacgagtccgtttttgaccagtagcttctttcaattcttcctttaattcagcagcttccttttctaagtcaacatcagctaaaagtttttgaatagcagcagctcccatttcagctttgaaccggtcaccatattctgcttttttatcacgatattcagcttcagttaaaagttgtttcttttcaagtggagtatcacctggatcaagaacaacatatgaagcaaagtaaataacttcttcaagcgaacgtggactcatatctaatacaagccccattcgacttggaattcctttaaagtaccaaatgtgagatacaggagcagctaattcaatgtgccccatccgttcacgacgaacttttgcactagtaacctcaacaccacaacggtcacaaacacgacctttgtaacggatacgcttgtactttccacacgcacattcgtaatccttggttgggccaaagattcgttcgtcaaacagaccttgcttttctggctttaatgtccggtagttaatagtctcgggctttttaacttccccatatgaccaactacggatcttatctggagatgccagaccgatctgcatactttcaaatttattgacatcaatcaaaggatgttcctccttctttcagtaaaccgtagcaacctaaatattaattttgattagttttgtcatcggtagttgttgaagttgcttcagacttgttttcttcttcgttcttcttatcgtctgctttatgttcttctgcatatttagctaatgcatcaacatttacaacttcatcatcatcttcgtccatgttctttaactgaatttccttgttgttaccatcaagaaccttcatatcaagacctaatgcttgtaattccttaacaagaacacggaatgattctggaacacctggcttaggaattggttgaccattgatgattgcatcataagtccgaacacgaccaacagtatcatctgacttgtaagtaaggatttcttgaagagtgtaggcagcaccataagcttcaagagcccaaacttccatttcaccgaaacgctgtccaccaaattgtgccttaccacctaatggctgttgagtaacaagtgagtatggaccagttgaacgagcgtgaatcttatcatcaaccatgtgagctaacttaagatagtgcattgaaccaacagcaattcggttttcaaatggttcaccggtacgaccgtcataaagaattgtcttaccgtcttctgggaatccagattcacgaacagcatcccaaacatctttatcagatgcaccatcgaatactggagtagccatatgaattccaagacgacgagcagccattcctaggtgcaattcaagaagctgaccaatgttcatacgacttggcacacccatcggactaagcataatatcaataggagttccatctggcatgtatggcatatcttcttctggcacaacgatagaaacagtacccttgttaccatgacgtccagacatcttatccccaacttggatcttccgcttttgtgcaatgtaaacacgaaccattgtatttacacctggtgataattcatccccattttcacgagtgaagactttaacatcttggatgattccaccaccaccatgaggaacacgtaatgaagtatcacgaacttcacgtgacttttcaccaaagatagcgtgaagaagacgttcttcggcagataattcagtcattccctttggagtaaccttacctactaaaatatctccatcatgaacttcggcaccgacacgaacaatcccgttttcatcaagatccttcaaagcatcgtcaccaacgtttggaatttcccgcgtcatttcttcaggtccaagcttggtttcacgtgcttcagattcgtatgattcgatgtggatagaagtataaacatcgtctttaactaatcgttcattaatggcgatggcatcttcgaagttgtatccttgccaagtcataaaggcgattaatgggttttgaccaagagctaattcaccttgttccattgatggaccatcagctaatacgtcatcagcatcaacatgttcgccaaccttaacaattggacgttggttgtagttcttaccaccgtttgaacgacggaacttcattaacttgtaagtatcaagtgttccatcttcttcacgaacccgtacttcacgagcatccacatattcaaccgttcctggcttcttagcaatcattgcaaccccagagtcatgggcagccttgtagtcaataccagtacttactaatggtgcatgaggattgatcaaaggaacagcttgccgttgcatgttagcacccatcaaagcacggttagagtcatcgttttcaaggaatgggatacatgcagaggcaacagaaacaacttgcttaggagaaacatccatgtaatcaatgttttcaacactggtttcgatgtaatcatccttatcacgagccattacttgatcgtcaacaaatgaaccatcatcatttaatggcgtgttagcctgagcaatgatgaagttatcttcttcgtcagcagttaagtaatcaatcttgtcagttaccttgtgatccttccaggaaacacgacggtatggagtttcgataaatccatatttatttacccttgcgtaagatgaaagactgttaataagaccaatgttaggaccttctggtgtttcaatagggcacatccggccatagtgagtatagtgaacgtcccgcacttcatatccggcccggtcacgagtcaaaccaccaggaccaagcgctgaaagacgacgcttatgagttaattcacctaatgggttggtttgatccatgaactgggaaagttgggatgaaccaaagaattctttaatagaagcaaccactggacgaatattaattaattgctgtggggtaacagtgtcaggatcttgaattgacatccgttcacgaacaacccgttccatccgtgcaagaccaatccggaattggttttgaagtagttcaccaactgaacgaatacgacggttacctaagtggtcgatatcgtctgtgctaccaataccttcttgtaagttaaagaagtagtttaaggaagcaagaatatcagctggttcaatgtgcttgtattctaatgggatatgaccgttaccaataataggtacaactcgatcaggatcattcttagaatatactaaaatcttttgtaacttaactggttcagttacaaccgcttcatctgatggagtgtaagtaatagtcttaaagtcatcacggtctaagtaaggttcaagcttattaagcaattccttggttaccgtatcacccttttgtgctaatacttcaccagtatcaggatctgctaaagtttcagctaaagtttgtccaagtaaacggtacttaagcatcaacttcttgtttgtcttgtaacgaccaactggtgccatatcataacgctttggatcaaagaaacgagctgttaataagctccgtgctgaatcagcagtctttggttcaccaggacgaagccgttcataaatgtcctttaaggcttcttcaacccgagaatcttcagcgttcttgtgaacatctttatccaaggttaatgataatgtctcactatcgccaccgaacatgtcgataatttcatcgtcagatccaaagcccaatgcacgaatcaattcagtcattggcaacttacgggtccggtcgattcgaacatatgaaacattcttagcatcagtttcgtattctaaccatgcaccacggtttggaataaaggtagcaccgtagtttggccgaccatttttatcattttcttcactatagtagacacccggtgaacgaactaattgtgaaacaataacccgttcggcaccattaataatgaatgtaccttggtcagtcattagtgggaagtcaccaaagaatacatcttgagacttaatctcaccagtttcatggttagttaaccgtaacgtaacatgaagtggtgctgagtaattagcatcgtgttcacgagcttcgtcaacagtatacttaggttctaaaagttgatagtcaacgaattccaaagaaagctttccttgaaaatcatcaattggcataatatcatcaaacatttcccgtaaacctttttccataaaccaattgtaagaatcggtttggatttcaataaggtttggcaattcgagaacttctttaattcgcgagtagctacgacgggtacggtgtttaccgtatttaactaaatgtccagccaaactgttcacctctctaatttattccgcgagctcatttaaatgttacaatttgattacaatttgcctaaaatacgacttttgggcaaaaaaaatccaaaaacagttcaacgactgtctttggcttttatgcagaatctgatggacaatagatcaccaggttcaaatgaactcacaattacatactactaaagtatacaagttctattaaattttgtcaacaattatttttatattttttaattttttccgccccaatttgataaaccgttaataatgcagtctaggattaattggtcacgttgttctggtgtaattgaatgaccaccaattaattgcgaagtgccaaaaattggagttagtcctgcaataaataattcagcagcttctttaggaagaatatcaggacgcaaccctacatctggttgacggaagaatgctgcaatcggttctagataatccattgtaaaaatcatattaagcttttgctgtgcacttttcgataataagcgcattgcttgattgtattggtcataaatacttaatggatgatgtttttttaatgccttagtgatttgccataattgttcattcggtgacaaatcatgtttacgcattactttattaatatcttggcgaacttttccacataaatttgtcattacatccagatataaaacctctttatcgctgaagtggtggtataaagccggttgagtaattccaatctgtttggcaatatcccgtgttgaagtttcaccaaatcccttttgtaaaaataattttgtagcggtttttaagattgcttgtcttgtcttttctaattgttccgctcgcttcatttattgttcatcccctatttttaatcattaattatctgataaacacattataagactataacttatcttttgacaaccgttttagaaaaataatcatcaaatgtgataaatgaatgcaatttggtagctttttcttctattatcattagagaacaaaagttacaattatagcgtttttataatacataaaactcaaatattcagtttgtgtatttcaaatttaacaaagctagaatgcaaaaacggtaaattactctgcattttcagaataatttaccgtttcttttatttattcaattttaattcaacagctttatcttcatccggcttctttactttaaaagtaattttaccttgatgcgcacctactgttacgtcatcccccacattgatttcaccactaagcagtccagtactcaaatcatcctcaacatgatcttgtaaagcacgacgaagcggacgagctccataagcgggattgtaaccaagctttgcgatcacatcaattgcagcaggcgtaactttcaagttaataccttgctcgcttacccgcttatttaaatcattaaccatgagtttaacaatttgatgaagttctttcttttgtaatgaatggaagataatcgtttcatcaatccgattaagaaattctgggcggaagtataacctcatttgttgcttaatcgccgccgccatcgcattatagtcttgtgacatatcttttgccccaaaaccaacctctttctcatcctgaagctgagttgctccaaggttagaagtcataataataatggtatttctaaaatcaacgcgccgaccttttgcatcagttaagtaaccatcatctaaaacttgaagtaataaattaaatacatccggatgtgccttttcagcttcatctaataagacaactgagtatggatgttgccgtactttttcagttaattggccaccctcgtcatagccgacatatcctggagcagcaccaatcaagcgactagtactatatttttccatatattctgacatatcaatccggatcatattatcttccgagccaaacattgcagcggataatgccttggcaagctctgtttttcctaccccagtcggtcctaaaaacataaaggaaccaatcggccgactaggatccttaagcccgcttcgtgcacgccgaattgccttagcgactacggtaactgcttcatcttgaccaattactcgttggtgcagaaccttttccaagttaaccaatcgttcactctcgctcttcttcaattgagttaaaggaactcctgtccattcagcaacaacttgtgcaatgttttcaccagttactttcaatttatagttatgagaatccttttgttgagtacgttgctttttgcgatcaatcttatcttttagtgctaattcttgttgacgaagagtagccgcacgatcaaagtcttgattatcaattgcttcttctttttgggttcgcaaatcttctaactgactttctaatgaaggctgatgatttttcttatcttcagcatcaatccgaaccatagctgccgattcatcaataagatcaattgctttatccggcaagaaacgatctgaaatataacgatccgacaatttaaccgcttcttccaacgcttcatcagtaatcttagcatggtggtgttcctcatacttcggtcgtagtcctcgcaggatttgcagggtttggtcagtagttggctcatcaacttgaacagtagcaaagcgtcgttcaagtgctgcatcagattctatatatttctgatattcgtcaagggtagtagcaccaattgtttgcaactcgcctcgcgctaaggccggtttcaaaatattggaagcatcaattgcaccttcagcgccaccagcaccaattaaggtatggagttcatcaataaaaagaatcacatgcccgtcgttttgaatctcatcaatcactttcttaaggcgatcttcaaattctcctcgatacttggtacccgcaactaatgatcccatatcaagcatcatcaaacgtttattagccaattcagctggaaccttaccatcaaccatccgctgagcaagcccttcagcaatcgccgtcttccctacaccaggttcgccgatcagcacaggattgttcttggtacgacgactaagaatctgctccacacgtttaacttccttatttcgaccaattacaggatcaagctggccattccgagcaagttctgtcatatcacgagctagtttatccaatgttggtgtaccagtttgctgaatccgtcgacgagatgattgacgattaggattgcgttgctgactatcagcaatccctaaccgccgtaaaattacttttctcatctgtcgtggcacaacatctagactatataaaatccgtgaagataggacactttcatcagcgattaaggctaataataagtgttcagtgccaatcttcaatgcatgcatttgttgggcttctcgaccagctaacgataatacttgctttgcttttggtgagtatgggagataatctgaagctcccagattttccatcgttccatagccaattaagcgttcaatttcttcacgaatatcatcgtttgtaatagaaaattgttcaaatattttattagcaatcccatctttatccattgagagggcaagcagaaggtgttcagtccctactgcttggtgtttaaagtattttgcttgttcttgtgcaattgctagaacatgctttgcacttggcgtgaacatattatccatgtacaatcccccttttaactttcatagcgaagtcgattcaagaatgatactaatatccgggcgcgaagttgatcttcaaccttactatcattaactgctaatgcttgtttagataatgcaacaagcataaggtctccttcacgtctcgtaatcacgtcttcttcatataacgttcgaacaatatcaaaagcatcacgttcacgaaccgagtcgccaattgcttgaataagtgagtttagcacatttacgtcatcaagtaaattaactcgctcgattcgaatgtatccgccgcctccacgcttactctttactaaataaccattttgaatggtaaacctcgttttaataacataattaatttgtgacggtaccacatcaaactggttggcaatctcagaacgacgaatttcgacctgagctgagtcaccaagtatttcttttaagtatgcttcgataatatctgaaatacttttattctccattatatcacctcggctcttttgactaatcttgaccattattttaacacacttttagagtcggcgcctacttgtatgatcattcagttacacatttaagaaaataataaagactagcgaagcattcaagcgcaacactagtcttttagagaattaaatatgaactacttttttaattagtcgttatcgttgtgaacaaaatcaacaacattccgaccaacaaccttgttatccttaagttcttggatcatatcattaatttcgcttaacttacgagtcttaacaattgggtgaaccttaccttctgcaccaaattggaaacattcagctaagtcttgacgggtaccaactaatgaaccagcaacaatgataccatcaagaacagtcttagcaatgttaagcttcatgtcaccttgtggaagcgcaacggcaacaagcttaccatctgggcgaagtgaatcaactgcttggtcgaatgcagaggcagaaacagctgttactacagcagcgtgaacaccgccaaccttttcttgaatttgcttatcaacatcaccgtcatgacggttaattaaaatttcagcaccattcttcttagcggcttcaagcttatcaggattaccatcaacagcgataacatgagcaccaaatacgttgtgagcaagttgaatacccaagttacctaaaccaccagcaccaacgattgatacccattgacctggcttgatgtcagcaacctttaatgccttgtacatcgtaacaccagcacaagttaatgaagtagcttcaacaggatcaagaccttctggaaccttaacagcgtagtcagctggtacgatacattgttcagccattgcaccgtcagcagtgtaacccgcattaagaacgttccgacaaagagtttcacgaccagttaaacaatattcacagtgtccacagcccttgaagaaccatgcaattgatacacggtcgccaactttcaaggaagtaacgccaggggcaaccttagatacacgaccaaccccttcgtgaccgataatacgaccgggcttcttaccaaagtccccagcagcaacgtgtagatcagtgtgacaaagaccacaatattccatgtcaactaaagcttcaccgggcttcaaatcccgaagttgaacatctttaacagtaacaaaaccgtctactggatcattaataacagcagctttcataaggtaagatctcctttattaataaacaaattacttttttacaatgcttatagtaccataagtcctagacaaatttaaagtgaaaatttgcacatttaccgaaataaataattttgtttttttattaaagtactgatataacaataataaagtccagtaaatcaattctattcatattgtatagtaaatcacttactaattatcactaaaactttactgttacaattttagacgctccctattaatatggatgttataatttaatcaattagacaaaggagtgagtagctaagtgaaaatgtaaagcggcaacatattcgttacaataatcaatcgttatggaacggcaattgctgctgatatctacacccctaagaatctagaagaagacaaattgttaccagccatcgtaatcggggtaccttatggaagcacaaaggaacaggcagcagcaatttatgcaaatacgtttgctcaattaggttttgttacccttgcatttgatcaagtatacatgggcgaatcagctggcgaacctcgtcatgttgcttctccagacttatatgcggaatctgttagtgccgcagttgattatctaagtacaaaagcaaagcatgtcaatcgcgaacaaataagtgttatcggtatcagtggaggggcaggctttgctcttagcgctgcggctgttgatacacgaattaaatctgttgtaacaatttcaatgtatgatatgacagatattcgtgagatggctaatcttgctcctgaacaattattccagcttaaagatcaattatcaaagcaacggtgggacgattttgaaaatgggcagcctgactatcacccttccttcccagaagaaccatatgatagtattgacaatttaccaaatcatgatgaattaacaaatgagtggcttcgtttttacgctcttaaacgtggcttccatcccaatgcacgtggaactgcaacaaccacttctaatttagcaatgcttgaattttctgcgttagactatattaaagaaatttcaccacgaccaatcctatttgtttatggagacaatgctcattcccgctcttactctgagagagcttattaccttgctaaccaaccaaagcaaagattgatcgtagaagactgcgagcatattgatctgtatgataatatggaaaaaattccagtaaatcaaattgcaaagtttataaaggattagtttcaacgcataatcaaacgacaaatgccaatcagcgcctcaattatggagcactggttggcatttttcttttaaatgttttcggaaattaataataaaaaaactgctatctcttctactatagaaatgataacagtctttttaacttatcggaattacaagatttgaacttgcgacctctgcgtcccgaacgcagcgctctaccaagctgagctaaattccgaaaaaataagcgtaacagttaaactgtcacgcttactataattagtgcacccagaaggagtcgaaccttcaaccttctgattcgtagtcagacactctatccaattgcgctatgggtgcatataagcggaagacgggattcgaacccgcgacccccaccatggcaaggtgatgttctaccactgaactacttccgcatgtctctgataagttattccctatcaacgattattaatattacacgaaaatctcatcaatgtcaacaagaattttcaaaaaatattaaatgcggatgaagggacttgaacccttacatcaaaatgatacaagatcctaaatcttgcgcgtctgccaattccgccacatccgcaaattaatggaggatacagggctcgaacctgtgaccccctgcttgtaaggcagatgctctcccaactgagctaatcctccataaataggcttgctatataaatcagcctattcaatatatcatctatatgatcttttgtcaaatcctatttaagatttaattcaattaatttttcatcaatcatggctaagaccttcttagcagcagccggatcttcaacaaaatcatatttatcaccatcaataaccatcttaggactttcattataatcctcataccattgaacataacgctcgtttaagtttttataatatgaatataaggaaggatcattagcaatttgttcaaatgaacgtccccgcttcttaatccgttcaagcattgtctcaaacgaaaccctaattgtaattaaaaggttgggggctttttggtgtggttgctctggtaattcttccatcatgttacctaataatgaagaataaatatttgactctgtttccgtagctcgacccatatccgcgtttaacttgaataataaggcatcttcaaaaattgaacgatccaaaacatttaaatcattcgagtatgaatctttaatctcatcaagtcgcttgtttaaaaagtaaatctgtaataagaaaccatattttttaggatctttataaaaaagcggcaaaattttattatcgtcaacagattcatagaaggcttggctattaagatggtctgccaataactttgtcaaactggtctttcctgcaccgattgtcccggctaaagcaatcattagttatttccccctgtttcaaattcaaaaagtaacgaaaacaattctaacatttaaaataaaaaggagcgagtattttctcgttccctttttattaatgtctttagacctagttgagtgcgcgagcagagcgagtgcacgaaacaaaaaaccacctgctatgcgggtgggcgataaaaattatataaaaaaggcctcttttgccttaagatgtaggtgttcaagccaaagtcaataagggaaaagaggttatataaatatggctaataaattaaatagcttagcccatacgaagtggttatgtaagtatcacatcgtattcataccaaagtatagacgtaaagcgatcttcaatcaataccgaagagacctgagagattatattcgtttgttgtgcaaatataagggagtagaaataattgaaggtcatatgatgccagatcatgtgcacttgttagtaagtattccgccgaaactaagtgtctcgcagtttatgggatacttaaaagggaaaagtgcattaatgatgtttgatcgacatgcaaacttaaaatacaaatatgggaaccgacatttttgggctgaaggctactatgtgagtacagttggattaaatgaatccacgataaagaagtatatccgagatcaagagaaacatgatatagcaatggataagctaacaagtgtggaatattcggacccttttaagggtaagtgaggtagtataaacaccgcttaaagcggtggcaaagtagtcagagcattttggcttgagcaaagcgaaagccagcgccttgagacgccggcttttattatcggcttatagccgatgtgcaaaccacccgtttgacgggtggttatgattttattaatcatcttccggttcgtacgattcaccctttgttcgccgtgataaatcaaccttatcaagcggaatcaagtgcgtcttgtaacgaatcttgtagtagaagaaaagaattaagaataatggaattcccatgtaagtaattaaaatgttttgccaatccatttttacaaaagcatcaatgttttgaccacaaataacgacaatacatagagcaagcgcgaatactggaccaaatgggaaccctgttgcatgatacttcaattcagacagtgtatgtccttgcttaagaaatgctttcctaaagcggtagtgggaaattgcaattcctaaccatgcaataaatccacataatccagatgcaccaattaagtagttataagctttgggaccaatgaattgagttgcataggctgctaatgagacaaccatcgttcccagcaaagcataaatcggaataccacgccggtttacataaccaaaaatccgccatgcatatccttcacgcgcttgtgaataaagcatccgggttgaggcatataaaccagagttagcagcagaaatgacggcagttaagataaccgcattcattgcactagctgcaaaggctaatcccgcccgcttaaacacaattgtaaatggactcattgtaatgtttgaaacatcttgattcaataagttcttatctgtataaggcaggatacaagcaataacaaaaatagcaaaaatataaaaaagtaaaattcgccagaaagttgaatgaattgccttggagacagacttttctggtgtagcggcttcaccagcagtaattccaactaattctgttccttggaatgagaaaccagcaaccaagaaaacgctaataatcgctggcactcccccaacaaacggtgcttgcttgtagtggaagttgcttaacccaacaggcttaccgcccataattccaaaaataattgcaacaccaacaattaaaaatacgataacagtgaccactttgattaaagcaagccaaaattcggtttcaccataagatcgtaccgataaataattgattaagaaaattagcgccatcactgttacactaaaaatccagcctggaacattgggaagccaataattcattacaattcccgcagttgtaacatcaacgggaattgtaattgcccagttaaaccaataattccaaccaagagcaaatccgagcgctggatcaacaaatttcgtcgaataagctgaaaacgacccagtcaatggcatatatgttgccatttcacctagactcgtcattaggaaataaaccataattcccataattccatatgcaaccaatgctccaccaggtcccgcagttgaaatagcggatccactggcaataaaaagtccagtaccgattgttccaccaagagcaatcatggacaagtgacgcgtctgtaatgtccgttccatatgacccgtcgacttagattcatctgccataaatatatttcctccaaatttgtgtgtcttaacgtcaacattttcgaagaggataaattaaaagggtcttctgatcggtaaccctaccagaagacccaacttaatacctataattaatcgttgaatcaatttaggaagcgccccgcaattattgcgacagtctatagcctattatgactatagcccaacacctaccagaaataagctaagtagtgtttcggcatatttccctttcactaatactccggtgcttattcacctaatatcagttactaataaaatatgcaacctcttcatcgaatgaaattataccccactcaaataaaaatgcaagcccgattatttaataatgcgttgccataaatcgtccttgtcataaacaaagccacatttaataagcactcgctgggaacgataattactttgtttgcattccgcatgaatcgtaattttagatggcaaaatagaaataaatttttgaagtgcagctgtcattatgcctttattccattggtcttgctgcaaaagatagcctaattcataatgatgagcaattctttttccttcatccccataccaagggcttaatacaaccattcccactacatccccatttagtttcactaccataacatgattctggtgaacaaatatcttaatagcttgcacacgattttctctttgaagaggtaaaaataatcccactgctcgtgttaaattttcatcgtctaataatttaactattgctcctaaattgttattatcttttgctgattcaattataatttcacacatttttctcctatttcccgggaaataaaaagaggagcaaccaaataagattgcccttcatcaattccaattattaaatttcaacactacgaaagaacggaattcgttgtaatcgtggtgcccaagcgacatagagccattcagctacttgtaaccatgcataagctaataacattgcaccaatagtatcaaatggccagtgagcataaagatatacccgtgataccgccaggaagaaaactgcaaatattaataagatttgcaaaattgtgcgaacagatgctttttgaataagcggaattactattaagaataaaattgctactaccaagaagaatcctaaagtgtgcccactaggaaaactatagccatcatctgccgctaagtgttgtgcaggacggacccgcttaacgatgtgtttaatgattgttccaagcacatctccaccaaaaattgttcctagtgaccacaaagctggaatgcgataacctttcagccataaaacacctgcaataataaatacccatactaaatctaagaccggtttagctaaaaatgaaagtaagctcatcaaagcatggaaccaaccaatgtcttccagacgctgactagtaaataatgactgcaaaacagcatcaatcattgttagcactgacgaattaaacataattaatagcatcaatgcaagaaagaaaccaccgcttaaggcaaaacgccaccaacgatgatcatcacgttcaataaacataatcaaggattctcctaacttaaattaattaatcaaaaatgagtataccacagtgtcaaaaattccatcgtgattttttgattaaatatttatgaagatagttcaaaacacgatttaaaagttcccctaacccaaagccaagcgtaattgccccaacaattacaactacctgatagaaataaacagtaacaaggtggtaattaccaatagcaaaattacgaaccattttataagcctgtcctcccggcacgaatggaactagcgcaggcacattaaaaacaataattggcattcgttttcgacgagcagctgcctgactcaataccgaaattaagattgcagcaactaaattactaaacgcaaggccaattccactgcaataatacattatccaatagattacccatacgcctccgccaatcatccccgcagtattgtaggcacgtttaggaatgtttaagaggatcccaaaacaaactgtcgaaacatagcataagaaaaattgtaataatagggtactccaattcatctcctaccctcctaattaaagtgcaaaacaattactatcgcgctaccaatcgaaacggcagttaggatcgcctcaatccctcttgtgggtccgctgattaaatttcctgaaactaaatcccgcgccgcattagttaagggcactccaggaaccagaggcataactgcgccaataataatatcattaatattattagcgaggtgcatcttaacaaagatcaccgctaaaatacctataatcaaggaagaacaaaactctcctaaatactgaatcttaaattttcgtaagagatatgaaaacgcagcatagcctatcccaccggcaaggaagccggcccaagaatcagaaacattgcctgtaaagacaatcatcaatgcgccacttaaaattgcagcggcaaatgattcgtaccaattttgccatcttggcatcttttggcgatcaatcttttttaatttagcaaatgcttgtggaacatcaattttgcgccgtgctagttcacgagaaacttcatttacctccgcaattttacttaaattattttttcgatgacgaatagtaattacttgagcatggggatcattaattgttccgactacaattccggtcacagttgtaaatgcctgaaagtcatgtaagccagcactttgggccattcgagataaggtatcgttaactcgttccatatttgagccgttttcaattaaaagtctcccagccagtaaacaagttttaagtgcgagtgcttgtcgtcgttttgttaacatcttttcgccttctctgttcaaagatatttattattatcctccgtttagatagggagctcaatactaaaaaaacgaccggaaaaatccagtcgctttttagtttagtatttagtctttaacgacatttgctgcttgaaggccacgttcaccttcctcaacatcaaatgtaacatgttgaccttcacttaatgacttaaagccatccccttgaatagcagaaaaatgaacaaatacatcatcgccactttcacgcgtaatgaagccatagcccttatcgtcattaaaccatttaacagttccttgttccatattggaaatcctcctgtgcattaagcactaatataatttgtaattcgtctcaggtgaagagatccatttgcaatgaaacaatcgaaccaaccgcacttaaaaaaactacaaaaaccattgtatcacataagcaatcatttacataattaatctttattttcttgagctgtgtccggttcaataaaaatattatgtgatgccttatatgaaacattaatttcttggtcgttattttctttttgaatcacaattggtccttcaaaaggctcatggcgaattacagtaacttgttcttgaggtcgtaatcctaactcttctaagtaagtgagaagttcatgattatctaagaatcgttctagttcaactttttccccatcatcagcatctgccaataaacgatgcgttacatctggaaacttgccattagctgatggaattactccaccatgcggacaatgatcagggtgttgaagaaaagaatctaaggccgttgctaggcgatcacttgtctgatgttcaagaatttccgcttctgaatgaacatctgcaaaattatagtgaagcttatctactaaaaatgtttcccataaacgatgcttccgaactaattccgcagcatacttttgtcctttttccgttaaagaaataccggcatatggttcatgaacaaccagcccttcgtcagccaacttagaaatcatctcggttactgatccagcggcaattcctagtccaagggaaatctctttattagaaacttttttatgactaccacctaattcaaaaataatttttagatagtcttccttcattggagtcaaattgtttcacctctgggtattaaaatttggcctacgatcggtcattgtgtgtttttatatattaacattgaacccaaattgattatagcatattattaaaagtgtagtttggaaagcctaacttttttgttataagctttttacaaacccgcaatcgatctttacggaggagtaggtaaatcatggacgaaaaagtaacagggaaacgctttttagcagttcccctcctaaatgtattaattacaattgttgaaattcttggaggtattctctctggaagtttagccttactatcagacgcttttcataacttgggagattcgctttccattgtactaggctattttgcccagcatattgggggacagccagagaatcggcaacgaacttatggctaccggcgagctgaaatcctctcagcattaactaatagtattttcctgattgttatctctgtcttcttaattattgaagctatcaaacggttagagcatcctcagcatattaacgggggcattatgttaaccgtggccgtgattggtcttcttgcaaactttatttccgcagcccttttacatgctggtagcgaagacagcttaaatgttaaagcaacttatctccatattctaagtgatgcactttcatcagttgccgttatcattggaggaatcattcttacctttgttaatgttccatggcttgatcccgccttgacaattggggttgccctctatattgcttatgaggcttggccaattattaatcaaaccattaaaattctcatgcagtcctccccagatcttgattataattccatcgaaaatgatttaaagcaaatcgacggagttacggcagttcatcacgtccatgcatggatgatggatgaacaccgaatcattttctctgcccatcttaattgtgatgacttgccactaagccaggttgagcgaatctatagtcaagtagaaaaaatcttgtatgaaaaatatgggatctgtcacgttactattcaagcagaatatcaccgtgggaaagatgaaaaattattcaacactcctgttgatgaaaagaacgttattaataacgatttcaaagaggactaaaattaaaaggaagcaaaaagttgagcgaaaactcagcctcttgcttcctattttttttacatcgattaaaataattttccgactccatagtgaatcgtaatcgtaatcaaaccaataataatatttcgaataactgcaatttttacaagcccgttcccgagtttagaactgatataaccggttagagcgctcgtaaaagcaaccgctaaaatcacggcataccacttatatgcttcgggagcaaaagtcatcgccatcaacggaatcaagcctccagcagctgctgaaaaaagagaagaaaatgccgcatcccaagggttaagatagtgaccaagctcaatatcatacttaatccgaacaaccgtctcaaggggctttttattaaggaggtctttagcaattttgattgatgtttcaggggtaactcctttatttacataatagtcttttactgccgcaagttccccttcataatcgatttttaagagccgctcttctttagcaacggccgctttttccgtatccttttgagtagatacagaggcatattcgccagaagccattgaaaatgcacaggcaagcaaatcagataagccagcaatgaagatagtaaaacggtcacttgtcgctgctgctaccgataccaaaacaccgacaacagtcagaatgccatcatttgaacctagtacccctgctcgtaacgtattcagtttttcttccattgtttgcttctgatgttttttcaccttaatactcatttaatctcatctccctaccgcgcaaataattgtccaatcaggtatgtaactcccattgttaacaatccagcaactgcatttctgatcattgacttaattcggttagattttcctaaaactgccgcaaaataaccagtaattaacaaggcaatcagaactgcaattgcggttgctaaaattcgaacgtttgtgggggaaacggtaaccgccaccatcggtaaaattgaaccggttggaaaagatataaaggaagcaatcgccgcagcatatgggcttgtaaactcattgggattaaagccatagcgctcttgaacagttgtccctaaagcatctttttccattaattctttcgtcgcttgtttagctagttgcgaatcgatgtcttgagcttcatatttcttttgaacatagtcaaattcatgctggtattgattttgaaggcgttgcttttcactaatcaatgccattttttgcgagtccttttgggttgaaaccgagacatactcccccatacacattgaaatcatcccggcaagtgttcccgacaaacctgcaattaagatagaacgggcattactcgttgccgctgccaccccgataacaattccggcaattgaaataatcccatcattagcccccatcacacttgcacgcagaacgtttaccttttgtgctagtgacatctttttcttggacacatttatcccttctctcttttagtttagaatcattataacatagagatgagtaaaaacaaccaaataatcttcaaatgatattctatcttagaatcattaaaaaatatactttcatgtaaaaagcgatagtcctaatcagaactatcgcaataatcttaaaaattaaattatttattcataagcctgaacagtgtttgtccgaataacaaatactgacgttccagcatgacgagccatgtatgatgcctgagaaccaaccgccttacgattacccttcttaccaattgaaccaacaactaataaatctggctgaaaagcggggataacatgattacaaatccgctcagctggccgctccccacgatcaacaatcgccgtaatcttttctggatcaacgccgtaatcaattgctgcttggacatattcatttacccgttgacgtaattcgtcttcactactatgaacataatccttatctaagatttgatatacatttacccggtcagtttccagaattgatacaattcctagctctgaaccatcacgtttcgccttatcaaccgcgtatgagaaagcggcacgggcatctggtgcatcgtcaacaccaacgaggatcttcttgaacttctttggctttatttcgaacattagtattctcctccctatgttctacactttaacggtgaagcattactcgctcctcttcgttaaatcatattcttcactccttatgttactacttatctcgattttgtaaataattattttggccttcctaaaataaaagtgatttattaaagaattttataattattttttcaaattcacttctacacaattctcattttgacgacttatagaacaatcgatataataaaagttacttacttcttgataatatcaacgaaatggggttaattatttcatgtcaatgattgaatttcataatgtacaaaaatattatggcaagtttcatgcattaaaagatattaatttaacaatcgatgatggtgaaacagttgttttaattgggccatctggctcgggaaaaagtagtttaatccggaccgttaatggtttagatcctattagagacggtcaattaatcgttaatgggtttgaccttgccgataagaaaaccaatgtaaatttaattcgaaaagatgtcggaatggtctttcaacactttaacttatacaacaataagagtgttatcgaaaacataatgctcgcaccacgaattgtattaaagcgtccggaagaagaaaaccgtgagttagcaatgaaactgcttgataaagttggccttgcaaataaagctgaaagtatgcctgctcagctatctggagggcaaaaacaacgaattgcgattgcccgcagtctggctatgaagcctaaatgcctcctattcgatgaaccaacaagtgctctcgatcctgaaatgattgatgatgttttagacgttatgaaagatatcgctaaaaactccaacatgacaatgttagtagtgacccacgaaatgggctttgcacgggcagttgctgaccgggttatttttatggcagatggtcggatcttagaagacgattcaaccgaaaaattctttggcgaccagccttctacagagcgtgctcgcgaatttatgagtaagatcagtggtcactaaggaggaattataatgaaaaagtattggcgattgattagtcttagcgccctcctctttgttgctctccttactctttctgcctgcggtacctcaattgcaaaaaaagatgttctgaccgaagatatgcgtagtcaacgaattacctggggagttaaagcagatacccgcctatttgggctggaaaatatccggacaggaaagctagaaggatttgaaattgatcttgcaacagctattacaaaaaagatcctcggcccacagggaaaaccaatttttgttcctgtaaccagcggaacccgggtgcccctattaaaaaatggtaatattgatgcgattatggcaaccatgacgatcactcctgagcgagaaaagcaagttgactttacccattcttactttgatgctggtcaatctctcctagttaaaaagggaagtccaatcaaaaacatcagcgatttaaatcgacgaggtgctgtaattcttggggtttctggatcaaattcagttaaaaacgttgcgaagtttgctcctaaagcacgtgtccttcaattatctgactatgctcaagcgatgacggcccttaaatctaaacagggggatgcccttaccactgataatgggattctctatgggatggcagctgaaaacccaggctatgaagttgtcggcggtaactttactaaagaaccttatggaatcgccgttaacaaaaatcaaacgcgttttcgcaataaattaaactgggcgttaagagaagttgaaaaggatggaacctacaaccgtcttcttcttaaatggtttggcaatgttaaaggatttaattatcaggagatgaagcgctaatgttaaatttaattataaatgagtggcatccccttttaaccggcctctggaatactattctatgtagccttattgcactaatcgggagccttattattggaaccttttttgcccttctcgagatttcgcagcatcgggttttaaaaatcatcggtcatgtctatgtggaggtctttcgtaatatcccactattggtaattacaatggcttttttcctgattatcccaatgtatgtagtgaaaattaatggatttactgcgggaacaattggcttaactctttatacgtctgcatttattgctgaaactgtgcgtgctggaattaattcaattgatcctggtcaaatggaaggagcccttgccaatggacttacttatggacaagcgatgcgctacattgttttaccacaagcatttcgcgttgttattccaccacttggcaatcaatttatcaatttggttaaaaactcatcggtccttgcctttgtcgctggctttgatcttatgtaccaaggaaatctaattgcaaacgataccttagcaactatgcccacgtatttcattgtcgggatcatgtacctcatcatcacgcttccgttgagttattatatgcgacaccttgaaaagaaattagcctaggagggatgatcaatgcaaaactttattgacgcttattcatggattaatatccgtttcctcctagaaggactttggattacgattgaagtttccgtaatttcaattataatcagttttattttgggaacttttctcggaattattcgttacgctaacatcaaatacttatcagcaattgtaggattcattatcgatattatccgtaatcttcctctcctgctaataattttcttcacctactttggcctccccaatatcggaattaaaccagaaattattcctgccgcaattatggcgctttcaattttcgaatcggcaatggttgctgaaatcgttcgctcagggataaattcgattgattacggtcaaacggaaggggcattagctaatggattaactaagtggcaagcattacgaattattgtcttaccacaagcaattaagaatatgatgccggctctcgttagtcagttcatttcattagttaaggatacatcactagcaacaatcatcgtcttgccagagttaatgtaccacgcccagatcatctatggtcaaaacacaaattatattattccgatgttcgttgcgttagcagtcctctactttattgtctgctactcattatcattggttgcacgttatttgcataaacacattgcataagtataaacagaggctgagaaaaacaacagttttttctcagcctcgttttatatgaatattgttacgatatcgcggaaattaaccacaaggcggttaatttccactcacttatttaatactgaatcataaagtcaaaccgttgatgctctccggtcaagcgattaacatgccgttccatcacttgacgtcgttgtccaaacatcatccaaacggcgattccaataaatactactaattctattcccgtcccaatccaattttgaactgttactttgccagtcatcaacgttgaatcagaagcaataaatgccgtccaatctaataggaagtgcattaccattgctagccataattgaccagtataaacataaacggttgcaaaaaatagtccaatcccagctgcgctaactgcttgtaaaacagtcattgaccattcttgagggccatagttggtaagatgaacaattccgaataaaattgaactcgttgctaatgccaacggaaggcgttgcttaacattgcgccaagcatagaataagatgccaagaatagcaaaacggaataaggtctcttccattaccgcagcctcaaacgccgaaagggtaaaatcccaattagcacggtggagccttggcatttctcccgtatttaaggccataaagataatatcaacaacaactaatccagcaaatatcccccaattaaaatcaccgctccagtgtggttttaatcctggccatgataaatgccacgtccgcataacagttgtcgtaagaataaagaaagcaactgcgccaactgcaccagtcgataatgctaataataagaagtgattatcaaccaagtctgttggtaaggcaatcaatggcgtaaaaaccacctgagctaaccaggcaataaagattagccgttcgatgctccaatgcatgaactcaccaattacgcttgcaaatggtgcaaacataataaagtaataaaaaatcatcattgtcacaacgccccgggatggtaaatgtaatagaacaataatttctcgaaccattacatcccaagcaaacactaaaattatcggctgggcaattacctgcagccatgcattcaactttttaactaacaaggatacattaggtaagagttcaaagactaaaccaattcctaaaataataaccatgatcaataatgctaatgcaacggtctgacgattaaattcgtaattacgaatcatcatcattgccaaaatgaccagggtcgccccaatttgaacccggtaccagatcctaagataatcgtttccggtcatttttcctcatcctctctgggaaatctaaaataattgctaaatatgatcataccaaacaatctccttagttttaagaacaaatcttctttttttagtttaaaccacaaaagaacctgcaggcaaaaaaactgcaagttcttttatcgtttattttgtgtttccagttgcaactggttgcttctctttactattcttctttttagaatgttgctgagagttccggtgggaatgattattctgtcgttcgtttttatgtgtttgattatttttattgtttggtcgacgatagtgttggttttcggaacgattattaccgttcaaaattgtcaccatcggaataatcactggacgacgaccggtgcgatcatagagtaatttttgtaaacggctgataattgtccggtttaatacccgttgatcaatgtgtttgtgattcttaaatgtattaaggattgcccagaatacttcatgattggctgccttaatcagctcttgtgattcatgcatataaacaaagccacgagaaacaatatcaggccccgcaacaatttgataatcctttaagtcgacaaccgcaatcgctgttacgacaccttcttctgaaagcaagcgtcgttcgcgaatttctggatttccaaccgtatctcccgcatcacgaccatcaatataaacatcactaacactatcaatatggtccgccactcgacaagagtctttcgtaagagctaaaacatccccatttgcaaggacaaagctattttcctttggtacaccagtcatttcagctaacttagtgtgaattttttgcattcggtattccccgtgaaccggagcaaagaacttaggcttcattaaccgtagcataaattcttcatcgacttgaccaccgtgtcctgatgtgtggatattattaacatacccgtgaattacattagccccgctctcttcaagcttattgatgagggcattaacactagtagtatttcctggaattgggttactagagaaaacaactgtatcttccggctgaatagtaatttgacggtgagtaccattagcaatccgactaagggctgccataggttctccctgcgatccagtacacatgatcaatactttttctggtggataattgttaatttcattttggtcaataagtgaatctttaggaatgttaaggtaccctaattcttgaccagcagtgattgcattttccatactgcgaccaaaaaccgcaatctttcgcccttgcgcaattgcggcatcagatgcttcacgcaatcgataaacattagatgcaaatgaggcaaagataatgcgtcccttaattcgttcaaagatccggcgaatatggatatcaacccagcgttcagactttgtaaattctggtcgttcagcgtttgtactatctgatgttaaaaggagaaccccatcgtcccctaacttagccatttgttgaagattaggacctggtaaattaccaactggtgttaaatcaaacttaaagtcaccagtctggacaatggttccttgaggagtatgaacggccacacccagggtatcaggaattgagtgcgttgttcggaaaaagctcacccataacttcttaaaatgaacttcatcaaattcattaatttcatgcaattcggcatttcttagtaagtgtttttcttccagttttcctttaattaatgacattgcaaatggtccagcataaataggtgcattgaccttttgtaagaagaatggtaatcctccaatgtggtcttcgtgaccgtgagtaataaagattcccttaatcttatctttattttcaatgaggtaatcataattttgaattacgtaatccactcctagtaattcatcttcggggaataaaactccacagtcaataacaataatttcatcttggaattgtacacaatacatatttttaccaatctcaccaagaccacccatggcgtaaaaggcaacttcattgtttttaatctttaattttgtcataatacctttccttctatagatttttatcatgttaattaacggaatttaagtaagccaaaagaaccgctttgttctgacaaggtcggttattgatattcattttattattggcacttaatcttaattatttaatccgtacgtaaaactaactattattttaccacatctacaaaattgaaggtagtaattgcctaattctttgattaaaaaagaaggtgggagaaagtatttatctttactccaccttcctttttaaatcccactagttgcttgcctaatcttcttctggtaactgttcctctttttgttcccaagccttcatccaatcaacaaccggttccccatcttcatgaaatttaacattagtcaatgcggttaaaattttttgataagctggcttacttagccgcgtgcttacattaactaattcctgatgacccataaaagcattatcgcacaagatttgattaattgtagccattaattcattagatacttgtgagctaaggatctctaaactgcccctacgatattgatcaacataaaaattaataaaggaattaagggcaacttctttagcatcctcgcttaactcactataacttaagcctgttgtagccaattgttattcttcctttctcaaattaatttactttggttatcctctacattttaaccttaacacaaagtttattatccgttaattttctttccgatcccgaatacgaagactagtcttttcaccatcaatcactgcatatacttcttttgtggaatcttcagctaatgcacccagcttaacttctccactatcttctccagtttgttctacctctttgatgccgtccgtaataaaacgggtaaaaatcttatgaagctcgcgccgttttcgttccttttttacagccatcgctaaagtaaaaccttgatccaaaaatactttaatcgttaatacctgaaaaattgttggaaaactaaaatagtgatttttattctgctcatcttgttcagatttaatataaccctttttctcccaatatcttagttgactagtagagacaccagttacacgtgctacttcactcatactaatctttaattgtttactagcgatcatttttctaattttttcagaaagcggatccattattttcctccaaagtgtatatttcaatcataaattaccaaaaattcgatatctttgtcaaataatttgacaaagatatcgaatagtattatatttttcacattgtgaaaaacgtagaggaggattctattagtgaatcaagagcaacaacctgttgatattaatggtcaaacttataatcgttccttaatgatcttcgtcctattaattggagctttttgtaccattttaaaccaaactattctttcaacagcctttcccgcattaatggatgcttttaatattagtactgccaccgttcagtggttaactactggtttcttaatggttaatgggattatgatccccgtaagtgcctatttaaccagtcgttttaatactaagagtctttttatcattgctatgtcaacctttgaagttgggacaatcttagcatggattgctccatcgtttgccgttttattagccggtcgtcttatccaagcggtcggagtaggaattaacatgcccctaatgcagaatattatgctgactgtttatcctcctgagaaacgtggcgctgcgatgggagtaaacggcctagttattggattagccccagcaatcgggcctgctctatctggatgggttatcgatagttatagctggcggtggcttttcggaatgatcgcccccattactgctttagttatcattgttagtttttttgcagttaaaaatgttattcctaataaaaagccgcatcttgactggctttctgttgttatttcaacattaggatttgggagcatgctttacggattctcaagtgtcggtgataaggggtggacagatccggttgtcctttcaaccattatcattggggtgattttagttggaattctaatcatgcgtcaaaataagctagacgatccgttccttgaattcaaggtatttgaaagcaaagaattctcccttgcgaccattcttagttcaattgtaatgatggcaatggttggggtagaattcgtcatccctctttaccttcaaatcattcatggaatgtccgccttccattcaggtcttacccttttatttggagcccttttcatgggaattatgagtccaattactgggaacttatttgaccgtcatggtgctaaacgcttagcctttacgggaatgtttatcttaactgttggaacaattccttttgcctttattactcgtgataccccaactatttatattgtcttcttatatgcagtccggatgtttggtatttcaatggtaatgatgccagttactacagcgggaatgaattctcttccttacaatctaatttcgcacggtacagctgttaacaataccattcgtcaagtcgctacttctgtgggaacagctatcatgatctctgttttgacaaatattaccaatagcaatcgacctgctcattcactgctgacacaatccccattacaatataaagcaaagatgtttgatgctactttgatggggtaccatgcagcattctggtttgcaatcgccttctcactcattggtttattccttacattctttgttacaagtggtaatggaattcacctccgccttgatagcgaagacattgcagaaccaactgataaaggagggatgaagtaatggttattattttaacttttctaggagcactcgccttttttgcttgcatgatgtttattcggcaaaaaagcctgcgaattattttagccacactcacgggaattatctttgtgggctcaactcttttgatgacactaaattacagtcaccattttggaatgcaaaaagttacgacaacaaccaccaagcggatttactctgcttcaaattcctcaatgcccctggcaatttatcaaccggttggtaaaagcggccgcgatgatgtttatatttataacaccaaagtcaaacaaaaaacgccttaccatacccaagcaaacgaatacaccactagtcgaattaaatggactaatggttctacccctcagctcgtaacaactgagacgcgctggcaatatcgtaataatttttataaagtcctatatgcatggtcaggaatgaacaatgcattagttaagcgaactaacgtgctagaatatccactaatgtatgttaaactcacaacgagtcaggcagataaacttgccagagttgctaaatctgctacgggtgccaaattacaagcacaagcagcagaacaaggacgcgcttttgttacatcaaaggttcaagcagcaatggctaagaatcctaacatgactgctaaacaaattcaagaagtatcagcacaagcagaacaagaatttcaggcccaaagcattcaacaaattttaaaacaagttaagtaaaaaatagtgagtgggaattaaccttctcgacaaggcggtgggctaaggatagaacggtgattagcacggcacgggctgattatcattcggacttagcctcgagccttgtggttacgacgcgaagctagttccacgatatcttaaataatcttcacataaatagagaggctgttaaaaaaacgaagttttttcagcctctctattttgtatttaaactaattcaaaaaatgctgcaggcaattctgaggtaaatgtcatttgtttaagggtgaagggatcgttaaagctaattttacttgcatgaagcaactgatgatcatatttactagtatcgccgccataaagatggtcaccaattagggaatgaccaatagcagcaaagtgaaccctgatctggtgtgtgcgtccagtgtgaagtcttacccgcactcgtgtccactttgcgcctcgttcttcaacccaatactcggtcaaagctcgttgcccattctcgtcaattacccgtgcagcctgcccatcctttcttccaatcggcttgttaatctcgccatgctcgtccataacctgtccttctactaaagcggtatattccttcagcatttgatgttgctgcacttgctgactgatcatactggaggcgatatgatgcttagcgataagaagtaatccccccgtaaagcgatccagtcgtgtaattaaatgagggcggagatctgcagaattatttgcgattaagtatccctttacccgatttaaaaccgtatcattttgaacggttggtcctgggatagaagtcacccctgctggcttatctactaccaaccaattatcatcttcataaacaacatttaagggctcattactactttcaacagtatcatcagctaattctggttgagccttaatggttaaaggttgattaggaagaatctgggttgttggccgtaccttccgatgatcaacaaggaattccccttcaccgtttttaagatcgttaaataaacgatgccccatccccaatgactgaagatacttctttattttaatcggttcggttcctcggtatatccacgtattttccatcttaatttcctccatcaacattgaaaaagatacaaaaaaagagctgatgacctaaatcacagctccttaatattgaacggtccgtacgagactcgaactcgtgatctcatccgtgacagggatgcgtcctaaaccaactagaccaacggaccaacttgacaacaaataaaagtatacgagatttatcgaaattagtcaacaaaaatttgtgatttatttttgatttttcgtttttcctatctataccgtaaaaattatcaatagtttataatgaaagtactagctattattaaggaggagtttttaatgcagcagttgggcaatcgcctattaaactggtggtctaagtattcaaaaatcataaaagtagtgtttgtaacctcagtcctagtctttgttattctcgcgttaggtaacttttttaaaacagttaaatggcatgaagtaggagttggtttagcaaacctgtcttgggaaagtatcatcctgctactaattacgggatgcatcgcagtcattcctatgttggggtatgattttgcaatcactcatttattacccgggaaatttaagaaatcatatattatccgctgtggatggattactaatactttaacaaatattgccggatttggcggaattcttggttctactttacgagcatacttctatcgaaagaacgcaactaagaaagagattctacttgctatctctaaaatcgctgttttcttactctctggtttatctgttctttgttgggtagctttgatcatcatgtttgtgtttcacgatggcggccacttcaaccaatacgcactttggcttgtgggaggcggattatattttccaatcgttttttattttactgttattcataatagtaaaatatttaagaatatcacgcccaaagtagggacctttttagtcaccagttcaacttgtgaatggctatttgtagcactttttttcttactagtcggttggtgcttagacgttcggcatagccttattagcgttctgccattatacgttgttgcccaagttctcggggttctttcaatgattccgggggcacttggttcgtttgaccttttaatgatgttagaactgtcattacttggcgtttcccaaactacctctgttatttggttattactattccgaattttttactacatcgttcccttaattattgccggattcatgttcttgcactctctggcatcccaagttaaccagtttttcgacggattaccattgctaatggtccgcaaacttgcttactatttaattacaacatttatgtatgtttctgggattctgatgcttattactgcctcaattccagacatcacagcacaaaataagattatcgcgaacctttatccctataccttcttcttcctccaccaattgacaaccatcttatttgcactggctatgcttgcctgtgctcgcggtcttcaatcaaaggtgaaaaaggcataccttcctactttaatattattggtaattggaattgctaataccatttggaacctgggaacattgagcttaacaatttacctcgtcattgttttgatacttgttttactctctcgccatgtgttataccggaagaaattggaatattcaattggaaaattcgcaattgatagtcttatctttgctggggcatgtatcctctatgtaattgtcggggttattaatgctcctcaatattccagtaagcaccacatccctgattttctatttttccctggtgaaaagatttggatttccggacttttcggattaatcctcggcctcttattaattttcgttattctgcgctactttatggccgggactgatcctttcaatattccaaacgtatttgatgctgaacggatccgcaatgttattaaagaatatggaggaaatgaaactagtcacctcgccttcttaaaagataaaagtatctattattacagtgttgacgatcatgataagctctttttcatgtatcgccgtaaatatgatcgcttggtcgtaatgggcgatccagttggagataaggatagttggcgaccagctcttcgacaatttgtcttagaagctgataagtatggctatcagcttgtcttttatgaagtctccagcgatatgacaatgcttcttcatgaatttggcttcgactttattaaaaccggtgaagctggccttgttaagctggcagactttacgcttgctggtaagcgacaacgatcacaacgaacattgatgcataaatttgatcgtgaaggctataccttctctgttgaaaagccaccatttagtaaagaattaatgcaagagatgaaacaagtctccgatagctggttaggaaacgaaacagaaaaaggattctctctcggtttctttgactcctactacattaatcaagcacctgttggcattatccgtgataaagacggcaaaatggtcgcctttgcaacgtttatgccgacagggggtaaaaagattttaacaattgacctcatgcgtcatagtaaagatgccccttctggaatcatggataaaattttcattagtatgttccagtacgggcaggaaaacggttatacctactttgatctcggaatggcacctctttcgaatgttggtgaatatcaatttagctttattgaagaaaaagctgcacacttcatctatgaatatggatatcatttgtatggctttcaaggattacggcgatacaaagataaatatgcgacagtttggtattcacgttatactgccttccgtaagaagaattcaatcattgccacaatgatgattctagttagtgtcgttaaccaacgtgttgatcagcaaaaccaccgttcaatcttctggtggttgattaaataatgttaagagggtgaggaaaaacttttccgtttttcctcaccctctttacttttatcgcctatttttgatccattaaataatcatatagcatctcatgcttaatcttatcagtgttgtatcctaatacctctgcaatctgataagcaaaggctaaggcagttgcgggaccacgactggtaatgatttttccgtcattatcaacaaccgtaatatcctcttcaaaatttgctgttggggcaaccttagcaatttcctcgttaattcccgggaagcaagtatagttatgattatcaagcaaaccataccgcgccaaggcaatcggagcagcacacattgcggcatcccacttattttctgcattgcgtttttgcatcaatttcatcaacctatcattatcgcgaagcttttgggcacccccgcgaccaccaggaaaggctaccacatcataatcgaggagccgatcactcattacctcgtcacaagttaattcaattccgtgagcgccaggaacataaagatcctctaatccgaccattgtggtttcaatccccattcgccggagaacgtccacaattgtaagtccttctacttcttcacaacctggtgcaaacactacagcaactttagccaaaatatcaccccatcaattattgattattgcaactacccgtttcattacaccctttgcttctggaatttgataaagcgggtaaatatgaaacagtccacgacccgtatatgagtttacagtgatcccagcgtcacgcaatttttgaacaaacaaggtcacatcaggatacattatttcccttgtccctacaaaaacagtcacatcgcgcaactgatcaagattcccatataaaggacttaagcgatagtcttgatgatccgtatcaccggcccacatcgtaccaatttttcgcaaaccgttcactgctagtgtaacatctttatcctcatatttgctaatgagaggatttgtaaggtcaagatcgagccaaggagaaaataagatgaggtgaccaggctgtggaagcccctttttaccaagatattcacaaaagccagctgctaatcccccaccagctgaatcgcccataatagttactttactagcaggcataagggtataaattttactataaaaactagcaatttcttggtaggcggtacggtaagtagcatgcggaaccaacgaataaatcgggacataaatcttcgcatccgtggcgattgccaaccgatttaaatattgccaatgagtcttatcggggcgctgaatataggctcccccggttaggtacatgattactcgttgattatctccatgatcatttaagacatatgttgttacttcctgttcttgacgttgaacatcaaccgtcactacagcagcaggcaagtagtaatcagcctcgttgtcaatccatgcgttccccactaaggcattaaacttattattttctgcaagatcgtttttaaatccgcttaattgaattcccatttcagcaaaggttgctttactagaacgatgagcaccacatcgtcgtaactctcgcaaactattctcaagattattagccaaatgactagcaatttgagtattaaatttctttattttctccactgaaacgatcgctcctcatttataatcttactattatcctatcatgatttaagattttgtgtctttaagattacctaaagccattagctcgcgttggtgacaatgattttgccagcctaaaatcacaaccaaaattaaggcaataacgattaaaattactgccgcaatgataatgtcgcgatatccattataaagtatcgtacgcatggttggtaaaagcttatctggaaggctactagcagtttgggcattcgataatttatttagcattcttaaggtaattccgcggtgcgtttgaacaccctggaatagctcttggttaagaataacgccataaaccgcggacataagggtctggctcaaaattcgcaataagtatcctagtgaagtagcaattggcacatcccgtaattcagcatctgtttgaacattaatctgtaaaatattaaagacaagaccaacaccgaatccttcaaaagcacccatgaataaaataagccagaatggtgttttttgtcccccaatcattattcctaaataagcaataaaaattgaggctgcaccacaggtaacaatccagtattttccccaccgttcctgcaataccggtactaattctgaaccaataaagttagtaaccgcacctggaatttgcgtcattccgccaagcagcgcacttaaacctaaaattccctgagcccacattggaatataagtgacaaatgcaataaatgagccccaaattatgacgaataaagtaaaatcaattactagttcgcgatttttaaacagacggctaggaacaattgggtcgaccgccttactgtcaacttttatcattccgccaagcaataagagaccaacaactattaaacagcccactactaagccagaagctgaaccaatcaattgaacagctactaaaataattactaaactgactaccagtaaagtcgctccaagataatcaactggcttaccggcagcttgctttttcacattcttatagaacaagctaatgatcgtaatcgcaattaaagcaatcggtacattaacatagaaaacccagtgccagctcaacgcgtcaacaatccatccaccgaggaggggaccaataatcgaagcagttccaaaacaagcactggcaattcccaatacttgagctcgtttttttaggttgtcgtacaattcagcaaaaacaataaacgggattgtattcattcctccagcaccaattcccattacagttcgcgcgataataaaccataaaatattaggagctaatccttgaaagattgctccaactaaaaacatggaggtagcagtaatataggcttgcttgtttcccttatgctcaccaaacttactccataatggggtcgcaacagccattcccaaaagaaaagttgcgatgatccaccccatatattgcaacccatgaaggtcactggtaatagctggcaaggctgtatttacaatcgtaccatccattcccgccatgatgttagatagtaacaacgcaccagtaacaattgttcgtcgttgttgtaattccactttttcatcccctttaattctctccgtactaaagaggatggaacagagcatctaagtgcgttgtcccatcctcttgaattacaaactgttttccattatacgaccttaggcataaaaagtataatggttattttttcattttcttaatatcctgccctaactgttgccaatctgctttaatagtaggctccaatcggcgggcatagagtactgcggccggatgatacattggcataatccaatgcttgtcagccgtcaactcataaccatcatgcgcatcattagttcgttgaattttttcgtggagaagttgcccatgaagcttactaatattagcctgactaccaagcagccgttgtaaagccgtattgccaagcgtaacaataattttcggcttaacttgtgctagttcccaatcaaacaaaggggcaaatgctaagacttcttttttagtgggagtacggttaggctttttttcaattacttcacccgtcttcttatcaactacctttttaatactataaggccgttgacgaactacactggtaatataaacggttgaacgcgaatatccgattgattcaatcaatttcatcagttcttgaccggaagcaccagaaaaaggaatatttaccttttcttcatgacgaccaggagcctctcctactaacatcaagtctggattaagtggtccttgacctggagtaaagcctgttaattgtcgatcctttgttttttcttttacctctgccaggagtgttggcggatattctgcaatcatattctcaatctcctatccattatgtcgccacttagaatctgtaagaatacgagcagcaatcaatcccattggcaagaatacaacaatcataagcgccttggtcatccaaagcgttcctacactaatcgaagttaaaccgatattatacattgcccgatacatataaagtcccgggaccataataacaatcgatggaaccgtgattgaaatttgcggatattgaatcttacgtttaacaatcgatgccaataacccggcaactaacgcccctaaaaatgcggctgctcctgccggtattccggtcaagtccgttaattctaagcgtaaggtattagcaatcgcaccaatacaaccggcaatagctgccattttaggcgtactgttaaacattattgagaagccaaataccccacaaaagctggctggcagccggagtaaaaagagcattaatgccgataggggcaatgcttgaaaattctcaggacgcaggttaaccattaatgctacaatccacccaaccaatgtagcaactgtaataattgcgattgcataggtcatccgttcaagcccggaccgcatatcaagttttgaaatatcaaggccactagtaataaatggaaatcccggaataataaacagcattgcgccgatataccctgcttcatgacgcgaactcacattaaatgttaattgcatcaaacttaaggccagcaggtaagaaagacacgcaactgcaaccgcgaccgctactcccgcaaataaggtaatgtgatggtcaatcatcttacggcggacatagtttccgaggccagctccgataaaactacaaaacatttcaactggtccaccccccagcagaaatacgaaggcgctacatgccagcgcagctgctagtcctacttggtaaggagcgtaatttccttttgagtgagcgatttcttccaaacgggagtggatttctccaattgtcatctcgctcccattctggtcaaattctttaataaatcgctccatctgcgaaagttttgtcgtatttacgcttgtgcttggcaaagatattgcctgcgtgtaactatggtgggcatccatacaagtatattcgagggaaactaacccaatatcgactgaacaagtcattttcaacgtccgggcaactgtattcattgaatcacggactcgccatgcccccgttccataagaaagcatcattaatccaattcgcccgacaatcgctgctcgttctactaaattagcctcatacgcaggggtgaaattatcgtttgtaaaaaagtcatgccatggaatcgccatatgatgcttatcagacaaatgttcagtcggctcaaaatcattcgctgagatctctttatccttactcaaaacccatccagctcctcgtataaattctcttaactatttaattatacggcgactgtcaagcgatgggagtaatttcttttaatttagtgattaattgctgttcatcatcgcttaaaatgtaatcctcccgtgtggcaagcgaaataaaaaacttttccggaattgggtctttaatatcgagggcaacaattcctggttcatcctttaccgcatctttaaccatcaaactaattcccttattttgccgtaccaactctttaatccaggaaacatttggcaccttataaattgccgtttgtggattaatttgggcataggtagaataagcttggaaggcagctttatgcacatattgctggtcataattaataaagatttcgttcgttaagtcttgaaaactaactgcctttttctttgcaagcggatgatcagcacttacgatgatactaaatggtcgcgcagttattaattccgcaaaaataccggtttgatcaattggcgcaattgaccccagcatggcaatatcgatctttcctgcttgtaattcacttagcaattcatgagaccccacagaaacgatttttattcgttgaagaagctgcttagaaagattgccgataatgtgtgaaatatacatttttccaatgattggcggaagaccgaattttatttgtcgttgatcggaccgtgctatttcttgatgggcaatatctatttttttgtttatcgccaacgctttttcatatagtaactgcccactgcgcgtaatcatttcatccctatgaacacgatctttgcgcactaattttgtgtcaaattcttgctcaaggcgacgaattgcctgggtaatactaggttgagaaacattaaaatactttgctacttgcgtataattttttaatttaactaacatggcaaagtattgtaaatcacgagtattcatcgtcttaaccctttctatgtcgaaataatatctttatcttacgtcaattaagtattcatttgcaattaagattctgaatattcttataatgcttgtattcatctttggcctaacaaaaaactacttggcaaatttcaccaagtagttttcttttaagataaatttttaccacattccaataactttcatccaaagactaccaataccgatccatacgacaaggtagaaaataccaaggactaagtttaatgaccaccacttcgattgtggaacataacctgaaccaaagagaacaggagctggaccagaagcgtagtgagtagtagatgccattaagttaccgaagaaaccaagcatcaaagctgcaagcattggtggaacatgagctgaaatagcaacagccaagaatgcactatacattgcagttacgtgagcagtagaactagcaaataggtaatgtgagtagaagtaagcaataattaagatcactaataccaaaatccagttcataccgtgaagcgagttaccaacagtcttactcaaccatggaataaatcctaaagttgtcaattgaccggccatcataacaagaacagagaaccatgtcaaagtattccaagctcccgtttcatgaagaacatcttgccaacttaacacaccacagaagagtaacaaccctaatgcaataaatgcagcaagtgttgcatcgatcccgataaaacttccgacaatccagagaactaaggcaataacaaagataacagccattaatttttctggtaaagtcattgctcccattttagagagttcgtcttctgcccattgcttagcattaggagtttccttaatttcaggtggatacattttgtagatcaaccatggaacaatgattaaggaaataatccctggtaccaaggcagctaagaaccaaccaacccaagtaatgtttacaccattactcttggcaagtgtttgaaccaatgggttagcggccatggctgtcataaacattgccgcagtaatcatatcaccatgatattcagcaaagatcaagaaagaaccgattttacgttctgttccttttttaggatctgaaccaaacgattgagacaatgattcaatgattgggtataaaacaccaccagcacgcgcagtgttacttggtgtagctggtgctaaaatcaaatcaacaccgatcaaggagtaagcaagtcctaaagtccgcttaccaaatgccttaacaaagttcaatgcaatccgccgaccaagtccggtcttaatgaatccccgggcaatgaagaaggccattgcgatcatccaaatcgatgcattcccaaaaccaacaattgctttttccattggaactgtctttgttaaaacagttaaagcaaaagcaataattgaaacaccaccaattggaagtggacgggtaatacatgcaatgattgtagcgacaaacaaagcaaacatatgccaaccagcaactggaacggcagccggtttaataggagtcataaaccataaaatcaaaccaataataacaggccaaatgaaccccttataatttacactttctaattttttcatttccttatcccttatatagttaagtaattaattgataattgctctaggcagtttctccctgcccattattttttactttaagccacgggcgtaaacagttacttgttgacctgcttgccgtccaaagacaattgtttctgcaattgagttaccaccaacacggttattaccatgtaaaccaccagcaacttcacctgcagcgtataatcccttgattacatccccattgccatcaagcacttgagtctttgtattaatatgaataccacccatagtgtagtgaattgcaggtgcaatatgaattgcgaagaatcctggcttagtaattccacgatccattcctgttgtccgatggaattctttatcgtcatgatttccaacagcttcattccatgttgcgactgtcttttttaagttctcaggatccatgttgaggttctttgcaagatcctcaatcgtatcgccatgaacaacaagaccaactttatcgtaaaattcaattgccttagcatggtcacgaataccttggtcaaaaattaagtaagcactgtgttctggaagggcagtaatcgcattagaaacaatctttcgagtgtttaattcgttaacaaaccgattaccttcagcattaactaagattgcaccttcaccacggacagcttcaccaataaggtaaacatgaggattatcttgttgaacagttgggtgaacttgtacaagatccatttgcattaattcaccgccaacgccttcagcaagcttcaagccatcaccagttgctcctggttgattggtagtcttgtaatcagcaaggtcagggcggaaccgtttcatgtattctttagaagcaccgaatccaccagtagctaagataacagcctttgcgtggatggttttaatcaggccatcagcattagcttcaacaccgattaccttgccttcatcatcttgtaagagcttgttaactctaaccttgttgaatactggaatgttttccttttgaacaacttccaataaactctttactaagaaaccaccaattggcgccatacttgctggacggtgagtacgcttgcgagacattccaccagtaattgtaatgtcatcaagcttaatcccatgatcagctaaccagtcgattgctggggctgtgtgatatacaaagtaacctagcatatccttgtcgtttagacgtccaccatcttggtatgtttcgtggtagaaatcggcaacgttatcaattactccatgttgtaattgcacgttggtttcagcggcgttcattcctgaagaagcccggttagtatttccaccaagttcttcttccttttcaagaacgaccgtcttcattcccaattcgtttgcttgaattgctgcggaaagaccagttccaccagaaccaattacaataacatcgtaatcattatctaacttgcttacagataatggttggaatttttcagccatgatattgctctccttttaattatatttaaatgtattaacagtcaaaaagagtggaacaagttctttttattgcttatctccactcttgccaaaattggcattacttttaactcagttcttatttatcccgatcaacgttggtcatcttaagcatgtccatccattcatcgtattgttcttcagtaagcttaccagacttcaaagcagcttcttttaatgtgctaccagctttatcggcagcttgagcaatcttagcactgtcatggtaaccaatgtgtggtgacaaggcagtaacagtcattaatgaattatcaactaattcttccatccgcttttcattaactgtcattccgtggatcatcttgtcagcaaatccagtaattgttccagttaataaatcagctgattcgaggaatgcatcaatcaatactggcttgtaaacattcatttcaaagttaccttgtgatgaagccattgttactacagtatcgttaccgaatacccgtaaagcagccattgttacagcttctgcttgagttgggttaaccttacctggcatgattgatgaacctggttcgttagctgggatatttaattcaccgtaacctgcacgaggaccagaagccaagaaacgaatatcttgagcaagcttgaacatgtcggctgctaacgtcttcaaagcaccgtgaacaacatccaaaccagagtggttagctaaaccgtagaacttgtttgaatcagcagtcaagtttaagccgtaaacttcactaagcttttcagcaatcttttcaggcattccttctgcagcattcaaaccagtaccaacagcagtaccaccaattgccaattcatctaatgttggttccaaagtcttaatgtaatcaaggtcatgttctaaggaagcaatgtaaccagaaagttcttgaccaaatgtcaatggaacagcatcttgcaagtgagtacgtccaactttaacagtcttcatgtacttttcttccttaacctttaattcatcaatcaagtgttgaacagctggtttcaacttatcaagcgcttctaaagcaaccacattcatcgcagttgggaatgtatcgtttgaactttgacccttgttaacatcatcatttggtaagatttcaatgtcagggttaatttcatgagccttgtgcgcaacaacttcattagtgttcatgttggtttgggtaccagaaccggtttggtaaacctttaatgggaagtccttccgcaattcttcatcacttaatgcgagtaattcatcaatcgctttaacgattaaattacccttttcttcagagatagctttagtttccatattagcttgggccgctgcctttttaatgttcaataaagcacggatgattgctaatggcatgtattgaccggttgggaagttattccgactccgttctgtttgtggtccccataatgcttcagcagggattttaacaggacctaacgtatcttcttcagtacggtattctgacatctcaaaaacctccaatatattaattgagcaattttgtcttgtgaaatgttacacatcatttacacgtatatcctaccttgtaagtaaagctatagtcaaatctttaattttcaataaatttcacttatagctattgccttacaaactgttataatagcttttttcaatcgtgtttgcaaaagtttcacaaacttcgatacaaaaaaacacctaagattttttaatttcttagatgcttttctatttttgtctaataatctggttttattattcacaaagatgaaagctgactgattaatatcgtggtttccaaattttctcttctaccactttcttcgcatcagtaatttcatcgcctgctaagccttggtcgatagcagattcggctactagttcagctactcgcttagaaaactctgttaacttagaaacaggaggcaacaccgccgctcctggcttttcaggatcaactaagccgcttaaagcatgagcagctgcagcaagcatattatcatttaacactttggcttcagcagccaaggcaccaaaaccaactccgggataaattaacgcattgttagcttgcccaatttggtaaacagttccattatactcgatatctttaaccggaattcccgttgcgattaatgcctttccatcagtccacttgagaaggtcggctgcttttgcctctgctaacttagttgggttagaaagtgggaaaataacaggccgtggagtatgggctgccacttcctttacaaccgcttcatcaaaacttcctggctgagtggatgtaccaatcattactgttggatgaacagccttaacaatcgcaagtaaattagttaattcatcagcattagcaaattcgctccgttgacgggtaaatggcttttgctttggtgttaagccgggcgtatcgtcaaataataatccttgcttgtcaacaaggtagaagtgcttctttgcttcttcgggggtcaggccttgacggatcaattcgtcataaagcatcttagcgattcccattccagcggtccctgcaccgaatgttaagaatgtttggtccgttaacttttcttttgagatattcatggctcctagcacaccagctaaggcaataatcccggttccttgaatatcatcattaaaggttaaaatcttatcctggtacttatcaagaatccgtgcagccgttccccgaccaaaatcttcaaagtgtaataaactcttagggaacaatccttcaactgcatcaacaaacttatcgataaagtcaaagtaaggttgtccctcaacccgcttaattcgatttcctaggtaattagcggacttcaacaatttttcattattagtccctgcatcaatagaaactgggagaacttgggatggatcaattccagccgctgccgtgtaaaccattaatttcccaacagaaatgtcaaccccatttacaccccagtcaccaatgccaaggattccttcagcatctgtaacaacgatgaggcgaatatcacgaccatcggcggcatcagtaagttcctctttaattaagtcaggatgctcaatgctcaaatatgcagcatcttgcggcttaatgtaacgttcattatattgctcaatcgcctcagcaattacgggatcatacacaaccggcataaactccgcaatatgtttttccatcaagtagaagaaaagcgtacggttagtattgaatacttccatcaacaggtggcgttgttcaatccgtgagttcttagattgatataaccggtagatttcgtctgcctgttcctcaatcgttcttacacaagatggtaacaagcctaataaaccatacttttttcgttcttcaattgtaaaagcagttcccttattcttaaagggatcattcaacatttgcattcctttacgcaacattatcgcctatcctttaccttttatctgtttcaacaatcttagggtaattccagcgctagtttatagtcaaatttatgctatgatataaataaaattgatagtacccattataattactgacagaaaggcatttactatgaaattaaacgacctaaaatattatcaagcactggtaaaatataaaaatttttcgcaagttgcagcaaaattcaatgtcagtcaacctactattacaatggctatccaacgactagaaaaagattttggcacgtcattttttgttcgtgaccatgtccataaacaattgcatattacgccgaccggtaagcaatttgccgttcacgttgacgttattttaaacgaattaaggattgcccgccaagaaatcaatcaagctgaatcatccagtattcgctttggcctgccacctattatcggcaattactactttccgccattgaccccgctattaatgagagaaggacttttaagtcacttggaaacctctgagcacggttctaaggaaattctcaagatgcttaagcacggcaaccttgacatggcattacttggatcgcttaatcccctaaaagaagtgggcttaaaaactaccgaactagctgagtatccctttaagattatcgttagtaagcatcatcccctcgcaactaaaaaggagattgattttgctacccttaaaaatgaacgctttattgttcctgatactgaattttttcatgagcaagcctttaagcaaatctctcatttggctcattttcgtccccaagtcatctaccgcaccgctgacattcacgttatcaaaaccatggttgcggaaaatcttggaattgcttatttaacaagtttagcgattaccctagaagataacattcattcattaaatgttactagcccgttaaaacaatcatttcgcctgtcagctgttacccgttcaactgaactgttaacagcctccaagcagaaattatgggatctcttaactacaaaaaaagaatgagagtggaaaataacctcctcgacaaggcggtgggctaagctagaacgatgattagcacggcacgagctgattagcgttcgtacttagcctcgagccttgtggcgacgcgaagctagtttcacgttatcttactattgttcataaaagcagttgaggctgggagaaaacaaaagttttcttccagcctcatccctttttattacttctctttttcaatcttaattgttttaataataacgtctttcttaggcttatccatcgcatcccgcttaaccttgctgaccttttcgacaacatccatcccggataacacttggccaaatacggtgtgatgaaagtcaagccacggtgtaccaccatgtttttcgtaataatcaataatctcttgtgggtacccaacggccttcatttgatcaatcatattttctggaacatgttcattagtgacaataaagaattgactgccatttgtgttcggaccagcattagccattgaaagagcaccagtgaagttaaatagttcttcagaaaactcgtcttcaaacgggtgaccataaatactttcgccaccacggccggttccagttgggtcgccaccttgaatcataaaatccggaataacccggtgaaaaattacatcatcataataatttttctctgctaatttaacaaagttttcaactgttttaggtgcgtactttggaaaaagttgggccgtaattgttcccattgtagtttcaattactgcttttggtccttcaacttcatccaatgataattggggatatttcataaataaagcctcctcttttctcttctaaacctctctaactatcttagcaggaatcagaaggaaaagacaattattagtcctcactaacacgtaatacacaagctcccttaatatcaccgtgcttaacatagcgtaatgcttcgtcagcctttgctaggggatattcgtggacttcaggatggatattaagacgatcagctaatgttaagaattcttccccatcacgacgagtattactctcaacactcgttaatgtcttttcgtggaatatttctttttggtaattcattgttggaatatcagtcatatgaataccggctaatgctaatgtcccccctggaactaaactagctaaagccggcaagaccatatcaccaaccggcgcaaaaatgattgatgaatccaaaggaactggtgctgggtcataggagccctgaacagaagcacaacctaattctagggcgaatttcttggcatcctcaccacgcgtaaagacatgcacttcaattccctgagcaagtgcaatttgagctgtaatatgagctgaaccaccgaagccatataatcctaggcgaccgccagccggaacattggcacgttcaaaggcccgataaccaataatccctgcacataataacggagctgcctctagggaatcaaacttttctggaagccgatatgcaaatccttctggaactgtgacatattctgcataaccgccatcatgatcccaaccggtataaagtgaatgaggacagagattctcatgacctgatcggcaaaacttgcatacaccacaagcatgccgaaaccatggaatcccaattcgctcaccaaacttaaatcgttgtgtctctggtccaaagccgacaactttaccaacaatttcatgaccaggagtaacgtgttcgtggtgaaccggcaagtctccttcagtcacgtgcaagtccgtatgacatactccacacgttattaccttaacaaggacttctccccgtttaggagtcggcacaggcttttcggtaaattcgattggtgattccttaccatcaatcggcccaggagttgtgactgcccaagccttcattgttttcggaatagcattttcgcgtttttccatccttaaagacctcgattaattaaatatttcattctctattgtagtgctttttattcataagagtgtcgtattttttcaatttgacgagaccattgatccttaaattttggaatgtttaacggctcattaatagctggatcatcttttgccgcttgggtcagcccttctactcctccaatatcatctaggattccatttccaaaaccgctaacaatttggggaccagtatgagccggaagtcgcttaggttttacttcctcaaatttaattttaaagttccacatatcgccaaagtcatatactaggttatattcatggtcaagattacaatcgcctacccaactttgagtaatatcttttgattgaccaaagccgctatcaagaatcggcaactgataatgagtattcccctgatgcagttcaaataagtggtgtccgtccgcgttaaatgctgctaaaattgcaaagcacaacatgtccagacgcgtatcaccgctgacggtaaatcgccgccacattttaggatggtaatcactaagctcaacataaatagtatattgtttattaacatattggattgcatgctcgcgttggtttcttacttgccgctgcatatcacgaattatacgttgcaggtgatacatccgctgtttagaaccaagatcttttatcccctgactaattgcttgaacaaacaaatcgtagtcttcactagagaaaagatcttctgcccgtaaaaacttcccaaattcgcgaaaggcatcacttttagaatgaaagccggtatcagtaggacgatcattatgtagtttttcatagttaattaaatagtgatagaccaaggtaatatcatcaagaacagattcgcccagggcttcacagtaaccgatgtaatctgcggcacaatccaaatcccgatcaacgatgctctcgctttttccacgactttctaaataaccttgataatcatctaaaatcttttctcctaccgctgttgcattcatgatatcgttaattgaaagtgagcggtaaagatagcgacggttatgttcattaagtttaggatgagtagccaccttaaagtccgtaactgaataatcttcaaaaacatccattacaacatattcttcgtccgttgtcttattggtaatccgtgtctgttccgctaattgaagtgcaatttcagcattggtcgggtctttttcccaatcaataattgaattaggccccatcataaggttctcatacatctgcaattgctgttgagtttctggctgaatttgacgtgtaaatactactttgctaaattgggcgtcacgaatcatcctaatttttgcatggggaattggcgaaacttctaataaacttaagaattcacgcttaaatgccgcaataaaagagcgtgagtcattaaagcgttgaggatagcgtacaataattggcaacgacattaagttattcataataatcatgaattccccagtaacacgaattgtccaaacatttgtctctaatagatcagatggagcaatcacctgtgaattaacatgcaaatgttgggcaagtgaattttccactgcaataatcaccctatcaacccctcctataatttcgcttatattaattttattttgaaaagcattatttatcaacttaatcaaaccatatttacaaataaattagaagatttaaaataagacataagtattgtctctgaaaggatgcgcaacttttgattaatcaaaatctcgatatctttgacttacgaaaaattcaaatcaataaaaccaaagctgaattggaaaataatggtaaacggcagcaaaaagtagtctctagtgacatgttaggaaccttcacgccagttgatcgggaccccgttaaaataattcagatcactgaagccaacatgatccccgagctgcttccattgcgtcaccaaagaatgattgccagtcgcttttcatttttccgtggaactgccgaattaatggaacatgaccttaaacgacaggctcaaagcaatcttcccataattatctgcggggatgctcatgtaaataattttggcttttacgcctcccctgaacgcaaacttctttttggccttaatgactttgatgaagctcgaatcggaaattgggaaagtgatttgaaacggttattagttagtgctgaactagcaggcgaagagaacggttttgatcgcaatgacctttaccacctccttcaattaaccactaagacctaccgccatactatcaaaagcgccaataagatgagcctttcccaactgttttatttttcatttgcctatgaagacatggggaaagcgattgagtcttttggtgatatttcaacgcaaatgcaaacagtccttaataaggttcttaaaaagagtcagcgtagcaattcagaagaaataatccaaaaaatggcgactatcaataaccaagggcaccttgtttttcgggataatccaccacgcgcacgtcatcttagtgctgtgcgttatcaacagattgttaaaggatataacaaatatcgcgaaaatgttcggcaagatgttcgagtccttttagcaaactttcacatttctgatattatccgctacagtgtcggggttggcagtttcggaacacgatgttacttaatcatgcttactggcaacgataatagtcacatcgttctacaagtcaaagaagctatgccattgcgttataacttactttccctccctgtacagcaagtgattagaaatggagggatcgctggtcaaagaattgtaacagcgcaacgggttctccaatcctcatccgatcgctttttagggagcactactttcggcggtcgtagttattacattcgacagttccgggatatgaaagaatcaattaatgttaataaacttgactttgaaagttttcaattctactgccagacgtgtgcttacttgctagcgatggctcatttccaaagtcccaccgcaccgatgatccgtggttatttaaaacatcaaaagatattagatactcttttaccaaattgggctttaaggtatgtagatcaagtcacagcagactatggacaattcaaattggcaatcgctaaaggaaaattaataaattaactgtaattaaaaaggacttgcattcatcgttttgcaagtccttccttaatactatttttaatactatttttcagaattttttcgctgatcacttccataacggtcttgttccttgattacactgcttttacggcgatgcttattaataaaatcttgctcagcagcgaaaatcattaaaaagtcgataaaatttttactaaaattctttttaaatttgtcccatttatttttggtcattttatatacctcataaatatcatctatctttgcttttatttattctagcatatctatttttgtgcaaacgattgcgtaattttaaaataaaattgtggtaaaatagaatttgtaaaagcgcttacttcaaggaggaaatattttatggaaatatctaaagtaccatttggaacctacaaaggcgatccagtaacaaaatacattttaacgaacgataatggtgttcaagtaggaattcttgattttgccggtttacttcaatcttttaaagttccaacaaaagatggtggtaaggccgatatgattttgacttctgaaaacctcgacgaatttactaataatggcttttgtactaatcgcttaatcggccgggttgctggacgaattgcagatggtaagttcagtattaacggtaaagattaccaaaccgaacaaaacgaaggtaaaaatgctcttcatggtggaactaatggtttttacaatcatatttggcatgttgacagcacagaagcaactaacaattctgtttcaatcactcttagtttaaccttaagtcctgaagttgatacgtatcctggtaagatgcatgtcactgcaacctacactttaactaatgacgactttctttcacttaagatgtcggctactactgatgcagatacgttgttcaaccctaccaaccacacatactggaatatggcagcagcaaatgttccaacggtggatcaattaaagctttatgtcaactccgaaaatcacttagctgttgacgacggcaagattccaactggtgaaaagatcgctaacgaaggaactccatttgactttagtaccccaactacaatgggcgatgcgctagaaaaaatgagttcaactaaggaaaacggttttgacgatatttgggaagttactcctagtctcacaaagccagttgccacacttgaagatccagaaagcggccgaaagatgagtctttactccgatcgtaacggattagttatgtatacgatgaactcagatgatgcagcggtttacaatcacggacaagttcatccccaccttggattagcaatggaagcgcaaaatctttcggatgcacctcatcacccagaatttggcgatattactttacatccgggcgaagaaaaagcatacaccattaaatggcacgttgaatactaattaaattaccaagtgaaatgcactaaaaaaagagatcgacaatttgccgatctctttttatgtgttaggaattataaattagtctttgtcatctgggttatacttcccagccttttgaaggatttcctttgccttttcaaggtagtggtgttctgcacggaatgccttgatcttgccaccttcatcatcggtaagagctgctagcttttcatcaagttccttaaattccttgttaaggtccttaataacgccttcttcatcttccatgtaaacatagtgattttctgctggatctttacgaccttcaccagcacgttcttcaagctttactgagtccttatctactttccaagcatgcttaaggattgacttaatatccttaattgtttcgtgttgagcagtacggtgcttctcattgtcaacactatcttcaatctttgttaagtgtccttcagcatctgcaatcttctttgcaatacgatccaaagccttaagttgacgttttgcgtaatcagccataaataattacctcctaatataatagctataattcctaattcacttttattatatttttataatttaaattataaaaataatacgtcttaaaattatagttaattttattatgaggtaatttcagcgcctaaataaatagatgattgatagaaattctcctattcaatcatctatttattaaaacatcgactttttagcaacgctttggcttgtacttactggaatattaaaatcaggcagtcctggaatatgcaactcaattgagccaacttgttgattcttctttatcggtgcagttagttgtttttgatcatctccctgcactcgtaatgttggtttagttgcttgtaatttcatattctttggaagccaaacggtagtcttctttgttagcttaatattagccttattcttatttttaccattctttacttttacactagtaagcttggccgaaagatcacttacttttttgatttcaactggctggtactcatcgactaatttattataaaagtcttgttgcatcttcgactggtcattccattccccttttgtatgcaaggcaactaaaataatccggcgtcctgcaaaggttcctgttgacacaatacatttacccgcgcgatcagtatttccagtctttaagccgtcaatttccccatccttaggagcaaaaccgttttgtggcaaaagagcattcacatttgtcattaaatattgttgatctttagttacatcaaagttagcaaacttttgctttgtaatgtcgagagtttcaggataattttcaacaagatactttgagataagcgcaacatctttagcagataataagttctctgcgtctttatctacgcccttaagtttatgctttcctaagtccccgttaggcagcccgatcatattgtagatttttatatctgtaactcctgcctttttcgcaaatgccatcatctttttattaaaggctgctgtactgcccgcgtcagctaatgccaatgcttctgtacttccatcagcagatacgagcatcatcgaatcaactaactgacggactgtgtattcttccccattcattaatgggacatttgaaaagtgccaatcatccgccatcttggcaactgctggtgtaatcttaatcttttgatcccattttaaatgatggtttcgaatatcttgtaaaattactcctaaagttaagattttaattacagatgcaattggatagcgtttagttgcatttttttggtatagaacctggccactttctgcatcaatcgcataagctgctcgtgcatccatctgaaaagctgcagtatcagcatggactttttcgaacatccccaagccatttaaacagatactaattattgccgttattaataataatttggcaaaaaaagatttaacctttttcattataacaatttctctcctttacacatttaactatcatatcctattctgcctaaaaaaggtgtaacgatttggtaacaattcaaatgaaatccttatttttcattaaattaagaagatgcaccttttaacttccataaattatctgtattattaataagtatgctaattttaatcagaaagggtcggttaaaaaatgcaaagatcgcaacgtcatcgtcgtaaaccgcgcagacttatcttaattatcatcgctattctgctcattattatgggtgtccggcacttcagctcgacaagtgcccgcctaaaatccgcatggaataaaatcattttcacttccaataataatgttagtattgcggtatactcaccaaagacccaccaaatttatacttctagtaatgtaccccagcataagtttcgaactgctagtacagtaaaggttagtattctagcgggaattcttgctaagcaacaaagtcctcttacaagtcatcagaaatcgcttgctactaaaatgattgaacaaagtgacaatgattcaactagcgaattatttgaagattatctcggcggaaaaaacggtctccaacaaacttttgaaaaatttggcatgacccaatctcaggctaatagcagttgggggttaactgttactactccaaaagatcaagttaaactattaaataatattttctataagtctaaagttttatctgatgacgaaagaagtgaaattcgtgatttaatgggtaatgttgaaagtgatcaagcgtgggggatctcagcaagtagcgataattttgcattaaaaaatggttggctaaattacggtaaagatgaatggatcgtcaatagtattggctacgtaaaaaatagtaacggaacagactacacaattgcagtttatacggataaaaatcaatcaatggccgcgggacaacaagtaattgaacaacttgctcgtgtaacaaagccaatattagactaaattgaaatgataaacaaaataggggctgaaagaaaacttcaaattttcttccagccccagtttttataggtagtttattgagagagataaagcgttttggaaaggaatactacctattttgttttgagagagattactaattaatttgatgtctatttttgttccatcactttttcaccattagctgtaatagtgaaagtcttgttagcagcatcagcatcaagaacagccacattcttgccatccttatctttccgcgtaaccttgatagttgtttcagttggtgtttccacttcaattgaaccatcaagatcaaaggctgcaaatttattccgccatgcaagtaagtctaagagattcttaactactggacgttgaacttcttgtgcaacttcttctttagtgtagtagtgacggttgatgttccgaccttccttagtcttttcaagtaattcaaggtcatttgaaccagcaagtaaaccaacatagtaaaccattggaataccaggtgcaaatacttggaatgcccgagaaagcaagtaagctttgtcatcgtcacctaatgcagagtagtaagtagagttaatttggtaaatatccaagttgttgtattcagcacttgagtatttccgcttaacgttagcaccaaccttgtataattcattggatgcatattcgatttcatcatcagttaagatatccttagcatcaacaaccccaataccatcatgagtatcaagagtagtaaattgcttcatcggtgacatctttaaccacttagcaaggcggttagtcttaccagagtaaagggtataaagagtagtcattggtaaggtaaagtcatagatgaagaagtcatgttgtgaaatcttttgtggaatggtgtagtgttcgtgaatttcaggaaggatgatggccttgtaaggagccaaaatatcttgaacttcatttaaaagatcccagatttcaggttcaacgaagaaatcattagtaccaaccttcttaatagcgtaagcaaaggcatcaagacgaatcatatctgcaccgtgcttaaccatgtcaattaatgtttccttgaagaattcgttagctaccttactcttaacattaatatcaatttgttcttcaccgaaagtgttccataagttttcagtagtaccatcatcaaaggtaatttcttgcttaggagccttatcctttcgcttgtaaattaaatcaacatcttcttgagttggacggttcttaccagctttttcccagaacttttcccaacgaataaagaagtcgttgtacttagaatcatcgtgcttcttcttgaagtcttggtacatttcagacttcttggaaatatggttaatcatgaagtcaaacattaagtagtagtcttcacctaatgcttcaacatcatcccagttaccaaaagcagaatcaacaacatcgtaacggtatggtgcaaaaccacggtcaccagttgatgggaagaatggaagtaagtgaacaccgccgattgcatcaccgatatagttctttaatacttcatgagtttctttaatatttttacccattgagtcagagtaagtaattaacattgcttcatttttgattggcataatgatatcctccaataattttaaatttagttagcttgtttagaatgacgagttgcaaagaaaataattaaggcaataactattagcattaccccgtagattgggaatggtgcggcaagatcaaggccactcattgggcgaccgactaatcgattcatccattcagcaattgttggtgagaagaaagctccaaagttaaaaccaatcagtaccattgaagttactaatggttgacgcttagcaggagctaaatccggcaacaagttaaaaatcaacggagaaactaattgtagtgggaagccgattaaaagcaaaccaattactaacattgcaaagttgccgtttgcgaaggcaaataagaagtttgaaatggccattaacccgagaccaaggtaaacagtgttaaaacctaacgctttattaattgatccgtagaataaaccaccaagcgttgccccaattaacattaaggaaaggaacattgatgaaccagtatagctacttcccttaattgcaacggttaagccagggaaacgattttccattccaacataatctacaaccaagaggaaggcaaagagaacaaggaggtaaactactggactaatctttttaattggttcttccacttcagttaattcttcagcaagatcatcttcggcaacgttattatcctgtgctttgctatcgtcaggaacacgaacggcaaagaagaagagaacaacaaaggcaagaaggtagacggcaaatgatgcatgccaacctgcatagctaagaattaacccagcaattgccagggtacaagcttgaccgatttgttcagccgcagcacgccaaccaagcatttgagctcgagttgtaccttcataccaaactgaaatcatcgaaattgcttgagaattgtataaaccaaaccctgctcctaaaactaaccgcgaaatcaaaatcgcagtgtagtcattcgcaaacatgggaacaattccggcaaggccaacaattgtaaccccggccataataatcttcttatcagaaatattgaaccattgttgaagtaatggtgaaaggacaacaaaaatcattacagcaaatgatggagtcgtaactaaatattctgactgtgtctgtgagattccgagtgccgcctttaattgcggtaaagaaccttgaatggcataagcactcgtaaccatgaatgaaactgacaggaacgccaatttggtaacaagagaatttttgttattcataattagtaggtactctttctataggtatttgataaacgtttatcattactgtacatcaataatatacaatgaagtttttaaaatgtcaaacgtttaacaaagatttcctacaaaaaattgtaatccattacattgttattataacgcgccttaaatgaaaatagatgaaaacggatgataacgctattttaggtctctttcgggattgcttgtgaattttcacgcattattttttataaaaaaagagtaaagcaatgaccgattcatcgttttactcttttcaacttagtatttacttaatccacacaaagcttcttgattgcctgagcatagatttccattgctttatacatgtctggcaatggccactgttcattagcttgatgcatatagtcgggagttgttggtaacattcccccaaaagcaacacaattattcatcgttcgggcaaatgttgctccaccagaaatttgcggttcagcagcaacatccccagtttgttctttataaactttcatcaaagtttgcactaatttactgtcttttggaacgtacaggggtgctaaataatcaaaatgaacatacttcaaatcataagctgccacctgtttacttagttttgctagtaaattatcgcgatcgatcgttacgggaattcgtaaatcaatctgcattcttgtttcattttcattaatttcaagactagaaatattgaaagttaattgtccagactcatcgcgaacatcaccgagaacattgctccccgttgcatcttccttaaataatttgccaataaaatcaagtggcttaaaatcaaaaacatcatcaagcgcaatcgctaaccgtaaaacagcattcgttccttccggtgccatcatcgcatgaacagacttgccaataacagtaattgaattaccgtcacttgtatattcaaagccatgcttatctaaagccgccttcacttcatcctgctttggaccatcgtacactgcactatcagggaccgcattaaacgcatttttcaagttaatctttagttgatctgttcctggaccaacgagataagattgttgcaaccccttttcagcataaattaatggaaattcagcatcaggagaaattccactatcaatcggcgcttcctttttattatattcagcaattccacgccatagaatttcttcatcagttccataaataaaacgaattcgttgattgaagtgataaccttgatccatcaatgctttaacagcatataaagctgcaattcctggacctttatcatcttgtgaccctcgtccataaactgcatcattgattactgtgcctttaaatggatcatgtttccatttgcctaaatcgccggcaggaaccgtatcaagatgacaaattacaccaaaaattttgtccccactaccaacttctgcatagccatagtacccgtctggatcttcataggtcttaaaacctaattcatcacaaatcttcatcatttcatcgagggcgttacgaattcctttgccaaatggtgcgccttcttctgctggttgattatatgatggaacagaaattagtcgttctaaaattttaacagcagctttttgttcatcttctgtaataattttatccattcaaatcccctcctagagcaaggcagcaattcctaagaacaagcaagtagcaacaaagagataaatcattaatttcagcatccacttccaccaaatgccgacattaatatgcgcaattgctaatgctcccataacaactcccgaagttggggtaataaggttaacccaacctgaagctgcttgataagcagtaataacaaggctaccagaaacatgcgcaaaatgtcccattggtccgataattcccatcgttgccgcagctaacccagacgttgatggaattaagaatgacattgggatatagaaaatgtaagtcaaaataataaagatcgtttgtgataatccatgaaggcccaattctccccagtgaagaactgttccagtgatcatcccattattcattattacttgaattccccgtgcaactgccacaataattgcaacgcttaagaaatctcccattcctgacatgaaagcatcaataaattcactttccttcatatggtaaacagccataatcaagaccgacataaagaggaagagcatggtaatttcattgaagtaccatgttccaaagggtgccatatcatgccctaataaatcgcctaggaatggaatattaaccaaccactttgtaaatttatcaaaaaatgtccaatggctattaaggtttgaccatggaattagtcctagaatcatcacaacaaaagtaattccgaatagccaaataactgtcttttgacgaccggtcatcttatggtcgtcattaggatcagccttgactaaaaagtgcttttcatcttctgctcgttgattgtaaactaatgatttagttggatctttttcaattaccgatgcatagtggtaaacataaataatactaatcgttatcgtaataattaaaaggattacccgggaaactaaaccatcaccaggagaaatatttaacgtttgagaagctactcctgtggcaaacgggttaacagttgatgctaaacaaccaacttgacttcccactaaagcaatcgcaaccgctacaattgaatcaaagccaacacccatcatcacggggatcaagagaggatagaatgcaatcgtttcttcccccattccatatgttgatccaccaagagcaaacagaagcattaaaattggaatcaattgtttttctcgtcccttataccggcgaacgattgaaccgatcccttcgtttaatgcatttgtcttattaaccactcctaggaatccaccgataacaagaataaatagtgatactgagatagctccatctgtctttttatcaccgaccatcccgataacgggtgccataaagatatcccaaattccctggggtttatttgtcaccgccttatatgtgccagaaataatatttccagctttatccgtctcatatgtccctgctggtataatccacgttaaaattgcaattaaaataataattaaaaataaaattgtaaacgcagagggcatatgaaaatgatgttttttcttcgtttgcgtttcctgcacaataaccgcctcttttgtaaaattagtatcaattttattttaattcagtttgaaagcggcttcaacttaatctaagaattatccttaaagaatgctataattgccttgtagtaattttaaggaggatgaagctaatggtaatgaatcctaataaagcacaagacgtttggaaagacgccggtgaacatgtccaatttactgtattagaattaaaacgagaaaatcaagcaaaggaacaagaagcaattcaagaatttgttgaacggttccaagcaattactcgatcactgcgaattcgggataataagggtaatcttaaagtttctttaggctttagcaacgacgcatgggactatcttttcccaaatgcccctaaacccaaagaattagaaacttaccaaacattaaccgggccaaaatacaaaatgcctgccgcaaaaggagatattttcctccatattcgtgcaaacgatgaggctgcagtttacgaattcatggctcaagtaatgctctttattagagatattactaatgttgttgatgaaacaaagggctttcgctattttgaaggccgggccattattggctttattgatggaactgaaaatccggaacctcaggatgctgctgaatacgcaattattggtgatgaggatcctacgtttgaaaatggttcatatgcctttgcacaaaaatggcggcataacatggacatttggaataagctaactactgaaacgcaagaaaaagctgttggacgaaagaagttttctgacttagaattaagcgaaaaagagaagtttaagaatgctcataatgtcgcttcccaagcggaaattgatggtattgaacagaagattgtgcgcatgaatgttccatattcagaccctgccgctgataatactggaactttctttattggttattcaaggcattggactgtaactaagaagatgcttgaaaatatgcttgagcaaaacgattatctcctaactttctctgatattttaggtggtcaactcttctttattccttcgcgtccaatgttggatcaaattgctgaaggcgaattaaattagttgattgacaagttgaaggcaaattgctatattattagtagcaaattttaagagggatcatccattgaaattttaattctacacaatttaatgtatctggaactgtggattcacgcagaaagatactacgggtagaattatttttcaatgattgatcaataaatgagaactaatgggccaataccattagtttaaaagtctacctgtagtggtgggctttttttcgttaccttttctgcgagtaacgaaagggtgattttttaatggaaccaatcacgataaataatttaacttttgcttatccgggacaagaaccgctttttaatcattgtgatcttaatattagcagcgattggaaacttggtcttcttggacgaaacggtcggggcaaaaccacactactcaaaatcttgcaaaagcaactttcctttcaaggaagtattcaaaccaatcttaagtttaactattatccattagtaattcgtgaaccgaatgattacacattgaatgtccttatgagaagtggctatcaaggtgagcaatggcaaatcgaacgagaattaaatttgatggcaactcccacagaattactatggcaacctttcagtagtcttagtggtggcgaacaaacacatgtgatgctagcaaccctttttgcccaggatggatatttccccctgcttgacgaaccgactaatcaccttgatcaggatggtcgaaaacaaattgctcaatatctaaaagcgaaaaaaacggcttcattatcactagccatgaccgagattttctcgataaagtcattgaccattcattagtgattgaacaacaccagcttgttttaacccgtggtaattacagtgattatttcgttcataaggagcaacgagattctacggccatcaagaaaaacgaaaatttattaaaagatattcgtcatttaaagcaaacacgtcaggcaaaatctcaatgggctcaacaagcagaaaatgaaaagaagaataattcgcatgcggataaaggctttattggtgccaaagctgcaaaaatgatgaaaaaagcaaccataatgaaaggacgcttagacaccgcaatcgaggaacgaaaaggacttttaaaagagattgaaaacgttgttccgctaacaattaatgtcctccccactaatcatcaactattgttaagcattaatgatctaacgttatcgtatccaactaaacaaccctgttctaatatcactacaaccattgaaaaaaatgaccaggtcctgctctgtgggaataatggtactggaaaatctagtattattaatgcaatcatcgggacattcagtggtaaacaaagcggagagatactttttagcagtgcccttaaaatcagcacagtgcgtcaagattattctgataatcatggaagtttacgtagttttgtatcttcttctaaaattaactacgatcaatttcttaaccttcttcgtaaattaggaatggaacgtgctacttttaatgttccgattgaagaaatgagtatgggacaacaaaagaaggttgaactagcacggtcattagctgaacccgctcacctttatttatgggatgaaccgctaaactatcttgatacctataatcagcaacaactaattcagttaattcaagaaaagcgatcaccaatgctaattgttgaacatgatcaaaatttcattaagcaaattgctacaaagaaaattgaaatttaatatttcctgggaaataatcaactttacaaagttagtgttaaaaagctgagagaaaatttgtttttctcccagccttaactgttttcacgaacaatagcaagatatcgtggaaattaaccgcaaggctcgaggctaagtccgaacaataatcagcccgtgctaatcaccgttctatccttagcccaccgccttgtcgagaaggttaattcccactcacaatcattagctaaattaaattcagttcagttaaccactcaagaaatagcgggaaccactttcccatatgattatctacccgatcattattaacaataccagtatattcgttagctaacgcgattccatgtcccccagtgccaaactcatgtaattcatatggaatatcattcttaattaacgcatctgcatatacttgaaggtgatcaacaaagggagtcagttcatcttttgccgatccccacataaaggttggtggtgtttgcggatttactaatttcgctacattctctgttgtaacccccatacgttcatcaatcaagggttgaataacaggatatcctaatgcggcgaatctagcgtgtgttagtttttcattactatatgcagcggcaatttggcctcctgcagaaaagccaataatccccaaccgatcagcgtcaacatctaattcagctgcatggttgacgatatattcaaatgcttggtgaaccgctattttggcttcttcataattcttatgctcaactaccggatatcgtacaacaaatgtttgccatgcatgggttgcaaacgttaatgccacccgttcagaatctcgctccatgatctggttataactgcctcctggtaaaataacaagaccgggcaaagctttatcagtattactatgataaatatctagagacgaatatggttgatctaagttaacacttttaatttccattttctcacctcattttgattttttaaatgtcgaaattacaatgaatagtataaccttaatctgagataaacgatacaggtaaaaaaatgttattaattcacaaatttccccttgtttattatgatacatttgttaaagtgataaggtatcaattattatttgggggttagaaaatctaatgagtattatgaagactaggtcattctggattgctgccattatgaccttaatttgttctgttgctggggtgcttttagcaaaactaccttatgtcaacttgattggagcattggtcattgctttattattaggtattgccatgcagttgactcctgctagcttgcggaatgaggctcaaggcggcatcggatttatttctaacaaatttttacggcttggtattattcttcttggtttccgcttaaacctagaaaaacttgcggccgcaggggttaagactattttggttgcagctattggggttaccggcacgattgtcctcacttattggcttagtcgaaagtttggtgcagaagatgaattagctatcctttctgcttgcggctgtggtatttgtggagcggctgccgtaatgggggtttcaccacaaattgaaaccgacaacgaggagcgcaaacgagaaaatgaagtattagctgttgctgttgtttgtgtaatgggaacagtctttactttagttgaaattggaatcaaaccattaatcgggcttactgacccacagtttggaattgttgccggtggttcattgcatgaaattgctcatgccgttgctgccggaggtgctttcggtgaagcaagcttagataacgcccttattatgaaactttcacgggttcttctcttggcgccagtcgctttaattgttggttactggtattaacaccgtcttgtagttgaaagtgaagaagaacatactaaagaaccaaagaaattaccaattccttggttccttggcggttttattttaactagcgtgttaggaacctttcttccattctcaccagcttttcttgatgcacttgttcaagcagcctatatctttttaggaatggcaatggctgcattaggtgtttcagtaaactttaaagttatttttaaacgcggaggagccgtttttggcgcagctgcgattagctcaacctgtttattggtgttcatgattattatgagtaaaatattcttctaattattaaaagcgttaaattgaggatttattttaaaagggcatatcgcctttcctccaatttaacgctttttatttatattcttctatttaactctctttcccagctggtaagcttcttcaacgtgtttagccaatttttgattattccaagaatcagccgcaagcacttctcctactttatcccaacgcatatattcaagcaattgcttaaaatataagtcaagtgaagcaaaggcatcttcttgaccatagccactcactaaagtaatagctttctttccgccatgaagttcatggttatagttgtagaaacgatcaatcactgcttttagggctgcattgatcccataataatatagcgaactaaccaagactaccatgtctgccgctaacagcttaggcattacttcattagtaataacatcattcggttcaatcgcaacttcttgtccgggatgattgtcttccaattcaatcatcgaaaattcatcagtccggcgtccagcatcaaagcgataaacttcatttcctgcttcagtagcgcccttaacaaaggcatctgctaattgctcagaagttcctggatgatggggacttcctgttaatacaacaatcttcatcatgatcccgccctttcttacttaattatagtgataattcgaccagattagaaatagaaacattgaatattaatagataactaaaatgaattaacgaggccaactaaaaatttttaaccaatttaacttagcacgctctcgtttttgttcttctttaatgtatgaacgatccgtaatgaaatgaaagatattcatgcctattcctcataaatatgttcactaaggtagcgctcgcttgaatcaggaaataccgtgactaaattagccccgtgtggcaattctttagcaacttctaaacttgccgcgagcgcagccccactagagctaccaataaagaggccgagatttttagcaacccagcgaacataatagaatgcatcctcatcactgattgtttttaccccggtataatctaagtccttgaaaaacggtggaataaactccactccaattccttctgtacggtgactatgggctggacccccatttaaaatcgatccggctggttcaacaatatagccttttaattctgggtaagcatcttggagcgccttttgaattcccgcaaaagtgccaccacttcctgcaccagctacaaaggccgccagcggtttattagcaagatcagctaaaatttccggtcccaaggtgcgttgataaacatcaggatttgctggattctggaattgtaaaggcacgtaagcatctccgatttcagcagctaattctttggcggccgcaattgctcctttgatcccttcttcactcggagtattaatcacttcggctcccaacgcacgcattaatgtttgcttttcaaaactaaacttttctggtaccactaatttaactggtaaatggtattttagtgctgctaaagcgactccaatccctgtatttccggcagttggctcgatgattgtcgttgtatcttttatttttccttcttccattcctcgctggattagcgccatccccaaacgatccttgatactgccacctgggttaaacatttcgagcttagcataaatattaacgtcattcggagtcttcatcggcaagtgcattaagggggtgtgaccaatcaaatcataagtattttcaactaacataatagttccttcttcctcagaaaagtaagtgggaattaacctcctcgacaaggcggtgggctaaggatagaacggtgattagcacggcacgggctgattatcgttcgaacttagcctcgagccttgtggttaatttccacgatatcgtaacaatatacctataaaaaacgaggctgttgaaaaaacaaaagttttttctcagcctcgccttatgtgttatcaacttgatagtaattcaattaaaaatgagtataccaaaaagtgagtcgcataagacgcgattcacaacaacaaatatttgcgttaacaaaataattgttttccattggtaatttcctcgtatttcaaattacagtaataataactagttaaaagtaagttgtcaagaaaatttatatggacaggtgtaaaataaaaaagaattattttataaagcaggagcgatacctatgaaaaagaatggactactattagtcaatctcggttcacccgatacgccaacaactcccgacgttaaacgttatttgaaagaatttctcagtgatcggaatgttattgaaatgcccccagcattatggcagccactccttcgtgggattattcttccaactcggtcatggcgatcagcgactttttatcgtaattgctggacaaaagatggatccccattaattgtctacacagaacggttggttgctaaggttcagggattaatgccggaatgggttgtcaaaatggcaatgacctatggcaagcctaaaattagcgacacaattaccggaatgaaaaaggaatgtcaaaatattacagttttgccgctcttccctttttttactaaaagtacaactcaaacggttattgacaaggtaaaggatgctgatccagaagcgaaaataattgatcgtttctcggccgaagaagattatttagacttattggctaagcaaatccaaacggcatgggatagaggaaaatatgacaaattactcatttcgtatcatggaattccgactgccatggttaatcacggtgatccttatcgcgatgaaacagaagcggccaccgcggaactaattaaacgtcttgacattcctgaaaagcaaattaagatggcttaccaatctaagtttggcccaatgccatggttaaaaccttacctccggaacacgctacttaatgaggcacaacttggacatcgtgatgtgttagtcgtcgctccatcatttgtggcggactgtttagaaacattagaagaagatcaagtgcaaaactatcaggtctttcgtgaaaatggcggaaataaccttgtaatggtgccttcactcaatgactcaccagaatttgctcagtttattactgatcttgtgcaacgaaagggataaaaatggaacgaaaaagtttagacgaaatcaatggaagtgttgatgttccaaatgtctatcaaagtgcattttggcagaaatttctcgcttatagtggtcccggtgctttagtcgccgttggttatatggatccaggtaattggttaacgtcgcttgccggtgggagccaatatcgctatcagctattagtggtcctttttactgccattttaatcgctatgtatatgcaatctttagcaatcaaactcggcgttaccacccgaaccgacctcgcccaagcaattgcgcggcgtttacctactcccctgcggattgccctgtggttatttaatgaaatagcgatgatggcaacggacttaaccggagtcgttggaactgctgtcgccttaaacatgttattcaagctgcccttacttatcggcgtcctgctaacaattgcggacgtgctagttgtcttatttttccttcattttgggatccgccgaattgaatttatcgttttaactgctattctggttgtcggcgccatctttgcgattgaagtctgtcgggcccaccctgaattttccgcgatcatggacggttttgttcctcgttccacaatttttactaatcacagtgagttgctaattagtttagggattgtcggggccacaattatgccccataatatttatcttcattcctccctggcgcaaagtcgacgctacgatgaacatgatccaaagcaagtcaaagaaacgctccgttttgctaattgggattcattaattcacctttttgcggctttcatcgtcaacgcccttctgcttatccttggtggcaccctcttctttcatgcagcaagtctcggtagtctcgaggatgtctttttcggactaaagaatccccaaatcgttggtagcctcgctagtccattaatgagttggctctttgccttcgctctactggtaactggtttaatttcttcaatcactagtaccttggccggtcaaattgtcatggaaggatttatcaatattcgccttccactctggaaaaggcgtctccttactcgagctgtaacccttgtgccaatcctaattatcggcttcatgattaatttcaaagaagaacaatttgagcaactcatcatttatgcgcaaatcgtcctcagtatcgccttaccatttaccctctatccccttgttgccttgacgggtaataagaaactgatgggaccacacgttaattcacgatggcaaacggtccttggatatattttagctagtttggtcactgggttgaacttgctggtattggtataatttttgtttatcattataaacccaatagatagatacccttattttcagttatcagtgtttaaaaaagcaatcaaatattgtaagataataataaattttgttgtaattgttgatgcaataaaagactgggcactatttacttttgggagagtaatttgatattaaaaattttatctttggtgtgacgcttttatcaatctcattttacaactgaattaaagaagcagggctgaacggtatttatgttcaaaccctgcttctttattttagtttcgtcgcgcaaccatcacgcgctgtccacctatttgtttaactttaatgtctttaaaacgataatattccagtagttgacgataacgttgcacagtagtagcagtaatcactatggttcccttaaaagcgagaacccttatcgcctcttgcaaaacacgtccttgcgtaattgccggtttcacctgctgcaaatcactaatcagaacatagtcaaactgatgatcagtgaaaggcaaattagtgttatcagtcaattctactttcgcgcgatcagctactgcctcttctttgatcagtcctttcgcttgctgtgcttgcttttcatttttaactattcccataattttgccgggagcagtcaattgcttggcaaggttaataaacgtttttccattaccaatgctcatatcaaggatttgcacatccccgcgtatcgataaatcagtacttatctttttccagacctgttgcctttgccagatcaaccatccaataattccaacaactataacaactatgatcccaataacgactatcaattctcttcacccattatttaactaacaatatcgtttagtttccgaatatcctttaactgcccaacaactgtgattttatcgtgcggttgaataacatcattagcttgcggcatttgattaacttcatcatctttactaacaatgataatcacattgacattataacgattacgaaaatccagttcgtctaaggtcttattaaagaacttgggattattaatatttacttctgccaaagttatttccttacttaaggtgacataatcgacgacgcttgggtttagttgttgaaaaataagtcgcttagctaaatcatgctctggacgaacaaccatatcagcaccaattcgttccaaaacgcgcgcatgattaacattttcagcccgacagattacatctggcgccccaagttctttagcgattagcgtggccatgatacttgcttcaacattttttccgattgaaatatacacatgatcaaaactaccgatatcaaggtcacgcagagcatcctcatcttgcgcatccgcaattaccgcccgcataactgaccccgcaaattcatttaccacttcttcactagaatcaatcgccaatacttcttggcctgcttgaactaaagcttcacatattgaggccccaaattgtccaattccaataacagcataactttcttttttagccaattaacacactctcctctggataacgataattcttcgctgctgtacttgcatttaggattgagaacattacagtataaattcctacccggcccacaaacattaaaaacattataataaattgacctaataaattaaggtgggttgtaattcccaacgatattccagttgtcccaaaggctgccactgcctcaaaagtaacatacgccaacgaatcatgttttggcaaatcctgtgtttcaacaagcaccaaaattgatacaagcaaaataaataaagcaacaaacagtaatgtcaaagcacgataaatattttcttgggtaaaccggcgatgagcaaatgtcgtgtctcgctgtccacgcaaagttgcaaaactctgaatcgttaatagaccgattgttgtggttttaaccccaccagcagttgaccccggcgttcctccgataaacatcaaaataaccgtaaacgcgaggccggcagcacttaaatcagtataaggaaaagtaattaaaccggcagttcgtggcgtgattgccataaaaatagtattgagaatacggttggaaaaacttaacttatcacttaattgtgctaagtttttctcggtaataaagtaaacaaccacagaaacaacgaataaaactgctccagtacgtaacgctaactgcgtatgcaaggatagccggtgatatttaggataattgagaatatctttccatactaaaaatcctaatgatccggcaacaatcaaaacagcaagcacacatagcatataagggtcattagcataatttgccatactattatcaaacaagtcaaagccggcattacaaaaggctgagattgaatgaaaaatactaaaccatattcccttaccgagtccgtaacacggataaaagtcaaaaaataaaaatattccacccgctaattggataagtaatgaaagccgaataataaggtaaaccacgttcaattgggataagtggtcaagattaagggcttcttgagttaataatcgtgttgacattcgcattcgttgccggatcagtaacgacatcatgactgcaaacgtcataaaacctaagcctcccacttccatcaagattgcaatcacaatctggccaaataatgtccagtgatgagctgtactaacaagagttaatccagttacgcaggttgcactcgttgaagtgaagaaagcagtcataaaatttgtcgtttctcctggtcgtgttgcaaacggcaaggagagtaaaattgttcccataaaaataacaattaagaacccaaatgtaagaattttgggaaatgtatatttatgtttatttatttcaatcacttttatccttcctcatatcaatattactcaactaattataagcgtttttgttaaattctaaaccattattttatttcccgggaaatcatctcgagaaagcgctacaatataactgtagattacccgattgcttttcctgaaaggagatccttttatgtactattcaaacggaaattatgaagcatttgctcgtccccgtaagccggcaggagtggataaaaaacatgcttacattgttggcgctggtttagcaggtctttctgcggctgtcttcctaattcgtgacgcccaaatgccaggcgaaaacatccatatttttgaagagttaccaatcgctggtggttccttagatggtcaagatcgccccgatgttggctttgtcactcgtggtggccgtgagatggaaaaccactttgaatgtatgtgggatatgtatcgttcaattccatccttggaaatccccggtgcatcttatcttgatgaatattattggctagataaggatgatccaaatagttcaaattgtcgcttaacttataaacggggcaatgaggttccaactgacggcaaataccttctcggtaagtcaactaaggaattgatgaaactgatccttacacctgaagaccagctcggcgacttaacgatcggtgattacttctctgaggactttttcaagagtaacttctggatttattggtcaaccatgtttgcttttgagaagtggcattcgttagcagaaatgcggcgatacgcaatgcgatttatccaccacattgacggcttgcctgactttactgctcttaaatttaataagtacaaccagtatgaatcaatgactaaaccattgcttgcataccttaaagatcatggtgttaagtttgaatacgatacccaagtccaaaacgtcctggttgataccaagaatggtgaaaagcacgctaaaaagattattcttaagcaaggcggcgaagataaagccatcaacttaactgacgatgatctggtatttgttactaatggttcaatcacggaaagttcaaattatgggagtcatcaccaggtagcacaaccaacccgagcccttggcggcagctggaaattatgggaaaaccttgctaaacaatcgccagcattcggtcacccggatgtcttttgtaaaaacattcctaaccgcagttggttcatttctgcaactgcgaccgttaagaatccacaaattgaaccatacattgaacgactaactaagcgtgaccttcatgatggaaaggtaaacactggtggaattatcaccgtcactgattctaattggatgatgagttggaccatccaccggcaacctcattttaagagtcaaaagccaaatgaaaccattgtgtggatttatggtctctattctgatacagaaggtaattacatcaagaaacgaattgttgattgtactggggaagaaattactaaagaatggctctaccatctcggtgttccagaagctttaattgacgatttagcaaaagaagagtcggttaataccgtccctgtttatatgccattcgttactagctactttatgccacgggtaaaaggcgatcgtcctgatgttattcctgaggggtccgctaacttagcctttattggtaactttgccgaatcgccaactcgggataccgtctttacaactgaatattcagtccggacggcaatggaagctgtttatagcctcctcaacgttgatcgcggggtaccagaagtctttaattcgatctatgatattcgcgaattaatgcgggcaatgtactatatgaacgataaaaagccgcttgaagaaatggacttgccaattccaaagattgttgagaaaccactgctcaagaaaatcaagaagaattggattggcgaattaatggaagaacaacatttactttaaaaaactaggggagtgaggcattaggtatctctacttttgtcccactcccttcaatttaatataaaggagtcttttttatgaccaatgaaacgattaagcaccaattaaaccatcgtacaattcgggcctttaagcccacaactctttcaacagaacaattgaatactctttactctgttgctagtcatacgccaaccagtatgtttatgcagcaaatgtcaattatgcacattaccgatccagataaacgggccgtaatcagagaaattagtaagcaaccgtatgtcggtgcaaacggtgacctgttcattttgttagttgacctttatcgtaaccaacaaatacgacagcaaaagggcaaggatgatggccgtttacataccgctgatattttcttccaaggccttgatgatgcaatcatggctgcccaaaacatgattactgctgccgagagtatgggcctcagcgttgttccccttggttcaatcaaaaatgagccgcaaaaaatcatcgaagtccttaatctccctaaaatgaccttcccagttttaggcttacaaatcggtatacctgaccaagaacctcaactaaagccccgcctgccattaaaatttatcgcatttgataatgactatccaaaagagatcaagctcagtgacttaagcgattatgatcaagaagttactacctactatgaccttcgtgatgccaaccaacgaattgattccttcaccaaccagattgcgggggctaaactcgatcgccactataccaagcgcgatgaaattatgaaggtgttacaccgacaaggtctttgcactgatgaaggaattgattagttcatcccctcaagagcagctaatgtcgttaaggtcgcatcataataatttttctctgttaagggtttactgaaaatgtgtttctggctagcaaacagattatcatacccttcattacgattgcagctaaccgcataaaaaatcggcgcactgaaactatttgattgatatttaaccaatcggtgaccgtttaatgaatagccagccgtaatataatactgttcactgaagaacctcatcattttatttaagactttctgagctcgtggatcattgctttttgccaacatcattggaacccgacaagcattcgcactatagtctccatcatattttccagcaaccgtattcggccccactggcttggtactccctggtcgagcccaggcaaagtcaggtactagtcctgttcggtgctgtttacttaatgcagtcagacggtcaagcatattatttttgatcatctgccaccttgaatcgtgagtacaatcgtataaatgatcaaaaactgtcggcattacatctgaagttcgcaataaataataaaacttagaatccttcgtaacccaatcacccactgttaacatgtgcgtggttgggttatattcatatttcataatatcagtggcaatctgttgctctagcttatgataataaggtgctttttgtggccaaacttttgcagcccggtgaagagccgcagcaatgtaaagatcaccatcagtcgcactattatgatcatcaacccattgaccttctttattataagactgacgccaggacattaagtaagttagctggtcatggtgttttccaacataatcgcgatgtgcaaggtaatagttaagtaacttatcaaagtcattttcacttgcccagcccttttcagcagcgcgagatactacttgcagcccgtagccttgtccttccgataatgcaacaggatgtttttggtcgttgctggtattaacatacgtttgcttattatttttgcggaccaaatatgtctcctgccaccgccgataagcttcgtattgaatatgttcaggattctttattcttacaaacgcgagcgttgcaatataaataactgcaacaacgagcgtaagaagccaaatatatactggacgtttcataactaatccccttattagtcagcaaaccgcttagtctttacccattttgtcccgtcacgccgtaatagtcgatcaagtgcaactgagattaccgcatgaatcgaaacaattataaataattgcgaataggtaaagtatgaagcaagcgctaaccagatttgcttattcgtcgcttgcccaaattgcgtagctgctgctgttgtaatttgtaaaatatacaagattatcattaataaccaattaaaaagcaaaagttgggcgattaggatgttactttccccgaatataaagggaatcattacctgtggattgaaaagatgaacaatccaaaaacctacgttcgctaaaaagattgcatcagaaagaacaattgccgcattaaaccagaaaaaagtacaggaataataaaaggtttctaactttactcgccaattgctctttctaaagagatacttaaaatttttaaggacaacttggtagtttccctttgcccaccgtaggcgctgataataataatcatgcagacgttctggttcctgttgaaaagcttccgaattataagctaacgcgattagttttccactttgcataatcttaaatgaaatatcagtatcttctgttaaggctccatttgcccagcccccgattgaacggacatatttactttgaatgataaagttagttcctggaatccggccaattttaaataaatgccaaattgcacagtgctggatccgttgggtaacaacaatttcttgattaatgcacttcgttaaaaagttttgttcggcgttgcgtgtcttattccggccaaatgctgcaacgtaccgtgttggattttcgagaatttttcgtactaagaaatagagggcgtttttttccggcattgcatcggcatcgtaaacaccaatatattcaccatgagccattttaagggcatcgtttaagacaccggccttccctccgctaccatgacgttctatcacctttgcttttcttttctcatattttggaagctgtaacactgttcgggcccgttgagcagtttgatcattgcaattatccgcaaagattaataattcgaccttatctgctggatagtttaattcaaggattgcttgggtcgtctgcgcaataactactgcttcgttatgagcgggaacaacaatcgtaattaatggatatcgttttaatgggacaatatccacaatttttctactatgctcaagccaaaagtgaactgccccacctaatgtaatagatgacattaatagcgaactccaaattgagatcagggtcacaatcattacaaactcggtcattgctttttcctttccctttttacatttagtgttgtctgttcaacgcgaaaataaatcacccactgaagaaccgcaaatattaatgcctgaacaaaaaagatcagggtaatcacgagcgctaaccaaaagaaaatccttaccattatctctgaacccctcttaggtactcaacgacaaggtctgtttccatatctctttcaatatgacgcattacacttttcagattcttaaatgaagtcgcattgatatcatcaaccttcaaatgtccccatttaaactgaggttttgaactattaatttgtaattcatcaagtcctgcacgcgtgctttggttctgataagcaaatgtaatagctggtaaattatatgacaaaattaaaaaagtaccatcttctaaatagtacaaggcttcagatggtaatcgtcgccgttttaagactttcgcaatttgctgaagagcatagttgtaatcattatgatgaaattgccgtatttggtgattatgaacccagtgaatcgctgtaacatcaatccacaaatcagcaatttgttctttagtaatgaattgaagttcctttttataaatcttattagcattatatgccgtctgaagttttactatttgattatagtgggtcgcatagctttctatctctgcgcgattacggtcaagccatccccattccccaataatataacgactaaagtaagctaaacttgcggtaattggaaaggcaaacagtagcattattttgattgaattatccattaccacataacctagcaataaaatggcactaccaatcgttgttaggccgattgcaagccaggttaaaataatatttggtactaagctccctaccattaagcccaaaatgatcataatcatcatggccgtcgtaataaaatgggcgtattgggatgcccaccacatcattaacacaattgcagtcaatattacacaaagcgcaataagccctgattctacaacatgtcgccgaatcataagaatgttctccctttcttcctataaattagcaactaatatcttagcacaccttttttagatttcactagtttaaaagtttggtaaataaggagttatgctttgtttgtaaaaataatttatcattttataacaagtaaattcccttgaaaaaaattactcttttctatatttaaatttatagacattcatattagatatgttttatttttgtacgttgataagcaaaagtacaataattaaggtaaacaaaaaagcctgatttaactttgcaggaaaaatcaggcttttaacttagtaaactcatcgatgaaacataatgttgctgatgttaattggataaagggatgcattgtttcaatgaagagtcttttatctaacttaaaaaacaagtggatttcttgtttgtaagtattatagcacacctgttgtgaaaatgttaactaagatttaggatgattaaatatttttcgcaacaatttcttatttatctactatttatcttattttccagcagtgattatcatcacaatatcacattatttctaattaaatttagaaataataaattaccttgtctatctctgattaaaattctcctcggtattttatagataatatcattgcttttatttaataattttcattatatctagttcattatattacaatttataaaaataaatatttttatgttattggtgttaaaaaaaggctaagataaaggtgataaataaattttgataaatttgtttaaaagaaatgaatttattattcctgatcacaccccatacggtcagcagcgatgattttatagctatttataaactactatttcattggattttatttatcaatttttatagaaaggagcagagtttttttactttgttagctaagcttaggggtatcatttgagttatttaatttactttatagctacttttcttcctttatcaaattgattaaattgcttggattcatatcactaatacttttaacctagtaattctcttttagcgtttctcattattcttagaagcgctgttgtttgatccaaaaatagaatattcattaatacgcagttacaaagcaatctctatatttaagctttctaatcaaaaagcaacctcagcgtcatcctttgaccttgagattgctttttaatttaattactgatttccagttaattttcgccggactaacgttggatcagcctttcctggatttaattcgaccagttttcccgatccactataaataatccattcggctaaattaacaatatgatcgccagcacgttctaaattccgaagaacagctaaataactttcataggcttttacatcttcgccacctttaaccagtgctttcatgatttctttttgtaattttacataaagtaaatcaactttcaagtcctcgttagcaacctcataggcaacctgctcatcagtatagacataagcatcaaggatttgttcaagcatcttgcgaacaatcatcatcatctgttcaattggctgttcgatgtcttcatgatgttcaaatttactcaaggtaatcgcagcacgggcaatatgggtggaatagtctcctaatctttcgatatcagtactagcttttaagatactgataattttccgaaagtcggttgcaaccgggttttgcaatgccattagcttcaacgcctgtttttccaaatgaatttcttcatcgttaatctttgtatcagttgttaaaaccttatctgctaagtccgcatcatgatccgtaaatgcctttgttgcttgatagatctgctcactagcgtcaattcccatttccatgaagtggctccgcagccgttttaattcatcgtcaaaaattgctcccatgttttcactcctaaccaaattttccactaaggtaatccgccgtttgttgttgttgaggattcataaaagtatctgccgtctggttaaattcaattaattttccttggtgcataaaagctgtccagtctgctgaacgtgatgcttgctgcatattatgggtaaccataataattgtaaatttctcttttaattgtacaagagtatcttcaatttgcgaagtcgaaaccgggtcgagggcacttgtcggttcatccattaagataatttctggctgaactgccagcgtccgcgcgatacaaagtcgttgttgctgccctcctgataaggcgagcgcactttcttttaagtgatctttgacttctttccacaaagcggcctgacgcaaactctcctctactcgttgatcaaggatttgccggtcctttactccggcaagccgtaatccataaataacattctcatagattgataaggggaacggtgtcggttgttgaaagaccatgccaatttgttgacgaatccggtaaacattaactttaggctggttaatattcaagtcatgaaaattaatttcacctttgaccgttgctaagtcatcgttcatccggttaagacttcgtaacaatgttgactttcctgaaccagaagccccaatcattgccgtaatcttattggccggaaatttcattgaaacatcatgaacaacgtgtttgtcaccatataatacttgtaaatttttcacttcaagagcaactgaattttccattcttttatcctcactttgcaagtcgtcgcttaattaaataaccaatatatctagctaataggttaaagattaaaattgttagaatcaaaaccgctgctgaaccatttgaaacagcacgggcatctggaaccaatccctcactgttaactttccagatatggacagctaaagtttcggctggtcgtaatggatttaagaaactggtaggactaaatgggttccaatcggtatagctaattgccggtgaactctgcccggccgtgtagattaaggcagcagcttccccaaagatacggccagcacttaggatcgctccagtaataattcccggtaaagcagccggtaaaacaattttagttgttacgcgccactttgacattcctaatcccaatccggcctggcgttgaagataaggaacttggcaaagggcgtcttcacatgcccgcgttaaaatcggcaagttcaaaattgttaatgctagtgcccccgcaagtaaggagaagtctaacccccattgcaaaacaaagactaagtaaccaaataatcccactactactgatggcaatgaacttaaaacttcaatcgccaagcgtaataagtttgtccaccgattatctggtgcatactcacttaagtaaatggcagcacacaatgctaaaggaatcgaaacgattaatgttaaaacaaccaggtaaagagaattaaataattgatcacgaatccccccaccacttctaaatgattcagcgcttgacgttaagaaatgccaagaaatatggggaattcctgatagtaataggtacgctaacaaggcaaataaaactaaccctactaaaccggttaaagttaaaataatcacggttgccaaccgatctactttttctggacgcattattttacccctttccggctaacgagccgcattaaaagattgaaggccaaggacattaccaacagaattaaagctaaggaccagagtgcattgtttgagatcgtccccatgactgtgtttccaattccggtagtcaaaacactagtcaaggttgccgctgaatgcatcaatcccgttggcattaccgtcgtgtttccaattaccatttggactgctaaggcctcaccaaatgcccgagccatcccgaataccattgcagttaaaatcccgcttttagcactcggaataatcacccgcgaaatcgtctgccagcgagttgcccccagccctgcagacgcattgcgatattgtttaggaaccgccctaaaactatcaattgtcatcgaggtcattgttggtaaaatcatcaaaaacaatacacaagtagcagcgagaatcccaaagccagtgccgccgaaaatgcgacgtaagaagggaacgattactgttaaaccgacatagccatatacgacggatggaattccgactaataattcaatggtcggttgaagaaacttatatgcggttgatggcaaaatctctgtgattgcaatagctactactaaggcaagcggcaaagcaattactcctgacaaaagagtaacgctaaaagaagtggcgatcatcggtaaggccccgaatacatgatcacttggccgccatttaatcccacttagaaaatcccacaatgaatagtgattgccagtaaagagggcaattcctttccaagttaaaaagattaagatcgttgccactagtcccccaattaaagtaattgcaagataactaattactttccctgaggcttcctgcttactttcaaccgagggctgtgtcaaacgttgtcgtaagtcttccatcgtactatttcctttcagttactttcccagttggtgttttttcaactttcatatcatgaatgctaatatagtgagcttctgttacaagcgtcttttgaactttctcgctttgcatatacttaatgaaatttgcagttgattgggatggctgtttttgcgtatacatgtgctcatatgaccataatggccacttattagtcgtaatgttatcagcagttggcgctactccatcaaggctaactgactgaacttggtcattaagataagcaaatgcaatatagctgattgcccctggtgtatttctaataatttctttgactgtcccgtttgaatcttgttcttgagcatttaccgcctgcatccccggtttcaataccgtctgttcaaacgcaacccgtgttccactcccatgagcacgattaataactgtaattggcaaatcaggtccgccaacttcttgccaattcgtaatttgaccagtaaaaatttgttgaagctgtttcattgttaaattcttaatgccaagctcttcattaacaattggtactattcccgaaacagcaacaatattgtcatctaatttattggcattaatcccatcttgctggtcagcaaagatatcagcagatccgatatttactgctcctgcttgtacctgactaagaccggttcctgaaccaccaccctgtacaataatgctggtttggggatgcttagttcggtaattatttgcaactgcttcagctaatggttgaagagctgttgagccgacaatagtaattttttcttgtgatggttgttgcttagcgagtacccatgacccgcctagccaacaaactattgcgacgataacaaccccgataatcgtttttttcattactattcctacctgtttattagttgttttcatatatttcgtatggtacaaatagagaatagcaagtcgatgtaaatttttaatctttgtaatgtaaaggttatgtaaattttggagaaagtattatgaccaagaaatttttgctaatgagccagcaagacgatctcgtccaacagttacaagctatttgtaaaaaagaacactggacctatgagctcgtaactactccaactggcttagtagtagccttagaaaaaaatcaaattagcggaatttggtgggatatgacggaggtaagcttagacactacgattgctaccatgacccttattcggtcgcaagtccaaggaccgattaccgtttttactcctcgctttacggaacacattcaacgaaaattataccgggcacatgttgatgatgtaattgcattccctctcctcctcagtgttttccgctccttaattcagcatcgcttgtggacttaccactatccacagatgcattcattagctgatgataatatgacaaaaaatgacccagttataactactggatcatgggaaattaatcaagaaacctatactgttactaaaaatgataaaacaatcgctttaacacccaaggaatttcaactactttcctacttagttgaccataaaggacaggtattaaatcgggatcaactcgttaatggagtttggggatatgatattcttgatacttcacggatcgttgacattcatatcagccacctccgcgataaacttgaagatgactcccaacaccctactcaccttcttacagtacggggatttggctataaatttgtttaaaataataaaaaatgagcgcggctggaaaaaaactcctagtccaaaataaaaccggatgataaattttttgaacaattcatcatccggtttttatgtacacaggaaatcgttcctgatatgatgtaattacccctaaaaacaaccaaagggagcgagttccacgtatcaaaattataccatagggcaaaccaaattcgtactaaactataactatgatttaccacagaatcatgttgcgcgactaattagtgattttgtcgactcgattccacaagatgtgctattagaagattcagtagcggctaccggccgcccttcatcgcatccagcaattatgcttaagattctcttgtttgcctacgcacgccaaacttattctggaagaaagattgaaatgatgttggatgagaacctaccaatgcgttggttagcttatgattatacttatagctaccataccatcaataactttcgccgcagtcagcacgccagtaagctaattaaacatgcctttgtctactttaccatggttttgaaagatcacggactaattcaaaaccatgcggtttttatcgatgggaccaaggtagaagccgatgccaataaatattcatttacttggcgacgggcagttgaaaagtatcacgctaagttaagagaaaagacaagtaagctttatgaggaactagtagaaaagcaagtggtgcaagaaatggcaccggagctggttacttccgccgaaggcatggacgtaatggaacaagaactggcggagaaaatcacttagctagatggagagattaagcaagaaccaaaaatcatcaaaggtggttcagtgagaaaacggcgccgtcgttttctaaaaagcttcgtcaccaattaagcaacgacctaattccgcgtgccaaaaagtatgaacgtgccgaaaatatcttccaaggtcgtaatagctattccaaaagctgaccacgatgcgaccttcatgtgtatgaaggaagatccaatgatgaatcgggagttgaagcccggctataacctgcaaatcgctacccataagcaatttgtccttgattacgggctgttttcaaatccaactgacaccaggaccttagtgccattccttacccagtttcatgctttagatttctttgaacatatcgtcgccgatgcaggctatggtagtgagtacaattacacaatgattcttgatcagtttgaaaagtagccggttatcccatacacaacctatcaaaaggaacagatcggactgattaagtatttggcttgcaattcctcaattatcgttatcaattgattatcagaaatattagtcaataattcgtgtaaatcatcaaagtccagcggttttattcctagccaaaaaagaactttagagtaatcagcattacgcaaaaagcttaaagaataagtaattccatgattagtttcttgattcatcattaacccactcccgcgtacaaaatattgtaatattcatcacaaattataacattaggaaaaagcaatctcaaaagataacccatatttatttatcgaattattaatttaaaagacagatttcttattaaagctcatttactcgttgaaatcgctatcaaaaccattatattgtatatttactttttagtaaaatttgtgcctcttttattccaaagaaatgtgatttaggactactcatcttatgagcgatcaatatttgttgcgcttgttcacactgtacttttgctaactcatttggctggaatatttgcagatagaatgataattgccgtaatttaatcgctaactggctccgcgccttcgtcaaagtcacatccttaaactgcttataatcatgaatcatgaaacgagttttccggcgctgtaaagcatagttaattgaattgctcttaatccggtgaagatcttgaactgtgaggccgtgttgacgaagaagataattaaacatcgtaatctgctggtcgacttgtcgccaatccgttgcaatatcgtctcgtaattgcttaatctcttttttggtaaggcggtgggcaactccttgttttaattgatggtataaggtttgcaaatcttgataatcgcgttggtggagtggaaggtcaactcgactaaacaagttacatcgctggtaaaagatcgttccttcgtggttcttaaatccctgctgatcaacaataaactggaatatctcttgtggaaaacgccgaccagcttgataagccaaaagaatgctatccatatacagattaatttcgttaattccggcctgaatctctcttgcaaccttttgaggaatactggcatgctgctgaaaatgagagatacctagaaatagttggcgtccacttgtacgagaacgtaagataaattgattctttaaacgccgaccacaatcacagtaaaggttgtcgccagggtggtcatgctgtcgctgataccaaggatcaattaccattccctgaaactcccaatcagtctgtttaagatagtgatgagtatgaaaacgcgatagcatcgcataacgtgtaaactcactcaacgcctgcacctgattggccgttaaatgttgtaaaatagcttctcgctgttgacgagtcaacgcaataattttatccatcctctcatcccttttcttaaattactgtattactatatcaaaacaaacgttcggtttcaaattgtctatttaatccttttctggtaaaatatttaattacaaggagtgatattatttggatttagacatacagcccgtgaggttgagtttaaaagaatataaacaagttaaacaattatatatgcgcgcatttccgaaatatgagcgagaaccgtggacgtggttgctcatcaagagtaagtatcaacgcgctgacttcatggtcttctatgaccaggaacagtttgttggatttgcttacgttattcacagtcacggtatgcattatattttgtatctcgcagttaatgatcaaatccgttctcaaggatatgggacacggattattaatgagcttcgtcgcctttaccctgaagattcacttgccctggatgttgagcaacctaatccccaagctgcaaataaccagcagcggttacgacgacttaaattttatcggcgcaatggctttttcccaactccaaaacttttcaaagaggaaaaagtcacattccaagttttagcaaccaataaaaaaatcaaccaacgaaagattgataaggccttcgagtggttctcatggccgcttggttggttgattcaataaatgtttcgattttactagtttgaggctgagaaaaagcttttttgctttttcaacagccttttttattgtcaagaaaataaggtttacaaaagcgttacaatttatgcaagcggatacataaagaagtgataacattggtagaaccattatttttaaagccagtctttcatgagaaaaattttttttggggggtggtcgacaccttgcaactgatttcagttaccaaattccagaagggacaattggggagtgctgggcaatttctggacatcctcatgggccaaatatcatcaccaatggtcaatacaaaggccaactattgccaaaagtttatcagcaacatccagagctgtttggtaatccacgctcttctgtttttccattattaacaaagattcttgatgctaatgctagtctatcaattcaagttcatcccgacgatgcttacgccgaagaacatgagcacgaactaggtaaaacagagtgttggtatgtcattcatgcagaacctggagcttatttaacatacggacataccgcaaaaacgcgcgatgagcttattaagatgatcaataatcatcaatggtcaaaactttttagtaaaaagccagtaaaaacgggggactttgtctatgtgccaagcggaaccatccatgccttaaacaaaggaattatcgtcttagaaacccagcaaagttctgataccacttatcggatctacgactatgaccgtcgagataaaaaacaggtcagctacgccagcttcatttaaaacaagcaaaagacgtgataacagtgccatttactgagccacaaattaatccccgtatcgtccatgatgatagttcaataattactactttaatttctcaacctgactcaccattctttaccgtctacaagtgggagatcaatgattaaaccagcttgacccacgatcatggtccctatactctggtttccattattgatggtaatggaattttaaccgttgatgatcaacaatattcacttcacaaaggcgatcattttatcattcctgcaaccgttaaaagctggacgatggacggtgagcttttagccattgcttctgaaccaacagattaatcatttgctatctgcagtattttagccacttgttttacaatatcatgcggtttttccgctttaaaaattaatttaaactcaaacgactgattgcttttcccggccaacggtaaatagcagatattttcaagtgggttttggagaaccttgatcagcttttcaggataaaacgctacggcttggcctgatccgactaacatctgcatctgctcataagtcggcactcgtaatacctcagcaggtcgtacaattccttggagactactggtaaaggcttgttttaaatatgatgaatcttcattactatagtaggttactggcattttctgaatagtggcaagctcaacttcattattatgacttaaacgctcgcttattccgataatcattcggtcacggtggatggtaaccgtttgtaatcccatttgtgcataattattgttaaatccataatcatccatcacaatggcacaatcaaggttatccattaatacatctgagaccaaatgttccacactctcttcgcttacaaaagcatttacagtgggcgataacttagcaagcagtttatggataaaaaggccatcaaaaggcgaaaagtagccaattgacaagttagttgcgccccggtaagaaaaacggtggagctcatgttcggttgcatctagcatattaataattgcctcactgcgtttcctaaagaattcaccagctggcgtcaaaacgattttatttttcttgcgttcgaacaattgagtatgaagattttgctctaaccgttgaatttgtcgcgaaacagcccgttgtgagacgtaattcttttccgctactttttggaaactgcctaattgaacaacatccaaaaataatcgtaataattcttcgttcatttttatctcctaggcgaacattttaattcgggtgtagacttccattaacagtctacactttttctttctaatgctacaataattttgtttaatatccagagtatttatattgaaaggaagagccaaatatgcaaattaaagctgctcttgcaaccaaacctaacgctgatttagagattcaaaccgtcgaattggatgaaccaaaagaaaatgaagtattaataaaaattgcttcaacaggtttttgtcatacagatattgttggtcgaagcggtgccactacccctctccccgttgtcctcgggcatgaaggtgcgggcgtcgtccaaaaagtaggagctaacgttacggacgttaaacccggcgaccatgttgttctatcatttagctactgtggccattgctataactgtactcataatcatcaaggcttatgcgaaaacttcaatcagctaaactttgaaggaaaaacctatgatggtactcaccgcctgcacttagatgatggcacgccagtcagtgtcttttttggtcagtcttcctttgcgacctatgtaacagccaatgtccataatattgttaaagttgatcaagatgttgatcttaacttattagggccactcggttgtggaatgcaaacaggtgctggaaccgttctaaattatattaaacctgctcctgaagatgcaattgccgttttcggtgctggtgctgttggcttagccgcaattatggctgctaaaattgctggagttaaacatattattgcgattaatcgtaacggtaaccaccttgacctggcgaaggaattgggcgctactgaaacgattaataatacggctgaagatcccgtcaaagcaattaaagaaatcgttccgcgtggtgtaacttatgcaatcgatactaccggaaacaccggtgtaattaaatcagcaattgatagtcttgccaccgctggagaatgtgtcctcttaggagttggcggcgatattaccttagacttaatgaatgatatcttatcagaatctaagaaaatctctggggttgtcgaaggagatagcaatccccaagagtttattcctcaactagttaagtactacaagcaaagcaagttcccccttgataagcttgttaagtactacgattttgctgatattaaccaagttatcgctgactcaacaaacggaaaggttattaagccaatcatcaaaattgatcctgaattagctaaataattaggtggagtgtttttatgaaagtaatttttgtttgccttggtaatatttgccgctcaccaatgacggaagcaatgttcaaaaaatggttgcagaagctggccttgctgatcaaattactattgattcagccggaacaagtaacattgcagaaggttcacctgctgatagtcgaacaaaagccattctcgataaatatcacattaaagacgacggaatgattgcccgtcaattgcaggacagggattattatgatgccgattatattatcgcaatggatcagatgaatgtccgggacgcaaaagatatggcaccagctgggttagaaaataaggttcatggaatctttgaagctaccccaggaaaagaaaattgctatatcgttgacccctggatcactcactgattccaagatacctatgatagcttaagtgaagctctccccaattggcttgctaagataaagaaggaaattaaataactgtttatcaaaaaacacgcctgaaattttcagccgtgttttttctttttattggtaattaagatcgtcaaacttcttatcagcgttttgttgcgccatatcctttgattggtagtaaacagcatctacccaatttccggcacccccggctgatacaagaactttaacctgctttccatcgattgtttcggtcttaacagtatatgatgaaccgtcaccggcattttgaacccaaccacggatatttaaccatcgtgatccatccatgttaaagaagctggctttcccccagttcttagtagcgttttggattccttcgttagtatagttatcctcgttttcaccccactcagaatcctgtttaaagagttgagttgttgtactgctattctcgccactgtaagtaaaggtatgagaaccaaatgttattgttgaatcagcatcattatctgccgaataccatgttccctgcatttcacttggaacatcaatagtaccactgcggccatacttatgatcattgccagaattactggtgcttgctgaggaattgctatccccactgcgcttatcgactacctgtgccttagcagctaagtcattaacgagctttccctgaccttcttgattaacataattggccatttctgactttgagattgtggcgagtttagtactcttttgattttccttgacattttggtagatgtttacatcatcgttattaacagtgtaaaccaagccctgtgactttccaccagcagtcacatcgtaagctactccttgtcctccatcactcaattggtatttagaacttgggtaaagatttacctgcaatccctctttttgcgcttctttaaccatggcagcccaatttccaccataacgaaggccacaatacgtactaatcaaactaacagcttcttgggggctcatgttatcactattaactttcacattacttttagccactaataaactactgcttgaggcagatgaagaattagccgctttattgttagcctgatttccacaaccagctaataataggcccatccccgtaaccattaaaaatcctattttcttattcatattaatatactcctataaaaaaatgaggctggagaaaatttttgttttctccagcctcaactgtttttatgaacaatagtaagataacatggaaaataaccacaaggctcaagtctaagtaggacgataatcgccgtcctagcttagtccaccgccttgtcgagggggttatttcccacttccatatttaactaagcccgtgacttgtagctaccatcagtagtgttgatgattaacttgtcaccgttcttgataaatgcaggaacgttaacaactaaaccagtttccatcgtagcaggcttaccaccaccatcgatagtagcacccttaatcattggttcagtttcagcaacagttaattcaacagtagttggtaattcaacaccaataatgtcgccgttaacaaagtttaagataaccttcatgttttcaacaaggtagttcttgtcgtcaccaagcaagtcatggtttaaactgtattgttcgtagctttcaaggtccataaatacggctgagtcaccttcatcataaaggtattgagcagaacgcttgtcaacgttaacttgttcaaccttttcagatggacgcatagtagtgtggacaattgaacctgaacggaggtcttggatgtccatttgcattaaagtgttacccttaccaggcttgtggtggttgatttgaagaacctttaataacttaccgtcacgttcaaaaaccataccttttttcaaatcaattgtttgaatcatagtataaaaactccttcatataaaactgaactcttttaccgattaatgggactttgctttaaagcaagccttaatctttggcttcgttccgtgccgttaatcatagatagttaccatctataatttacattcactatctattgtatcacattccctaatcacaacaatagcagttgttaggatgttttatcaataaaaaactgtctgcctatttcataattttcaatagacaaacagcttttttctttgatcgatacttctaaactagctcaagatgtaattgcttttcaccgatgaatccagcgcgcttaagaacaaggtaaagagcaattgaaagaacagcgggtactaccacgccgaaaaccatgtatgtgctgaactgagcccagccacgtgataagtaagcaattggtgcaatcaaggagtttagtcccaatcctcctaaggtcgatgttgaacggaaatcaaacagaactgttgcaattggtgcacaaacagctgctgaaacaaccgttggaactaaaagataaggattgatgaggagattggaaaattgaactttaggggtaacaagtccttgggcgatatttgcgccaaggttattttgccgaaatgacatcgcagtaaaaccaacaaattgagcagtagtaccgatcaaggcagccgccgaagagatcggatcaagcatcaaggcaactgccaaggctgcagaagaggcaggcgtcatcagaaatagggcccacacaacggaaattaccattgatcctaaaactggtgaaacttgcatcgaatgcgcaatgtaggcggacacagcaagaagcgccggcgtaacaactgccgcaacgactagaccaaaaccgatccccacggctaacgcaccaaatggaacaagaaccatatcaagtggcgtctttccagttaaatacttaccgacaagaacagcaacaagtgccgctaaaacagcagaaacaggttggccagtagtaagaaccggtgctcccgctgccgccgcagttacttgccctgttgcagtcattcctttaaccgccgtatcagtaaaatgaacaccatttgatccaacggtagccgctaccattgatgcaaatgtaactaatgtatttgtgttcatctgtgaagcaaccgcaactccaatagcaggcgctaataatgcttgagcctcaccaccaattagggtaaggacatggatacctgtcaagttaccaattgtttgagttaataatcctcctcctagaacgaccaaaatagcattagccaccgccgcaaaaattcgataggccacttccttgacctttgatgaattttgataagttgcattagctttagaattgctaactcgattttccatcattaacgcctccttataatttattttttgtttaataattgttgttagtttaatcggctcataattaaaagtcaattatatttctaattatattttaatgttaataaaatctcttatttaataaacatttcattctcaattacatcaaaagaaaaccttttcataaaaatatattaaagcttcattaacaagtgataattttatcatttgttaatcgttaagtatttcgttcttaatatatcactaggtaaagaaatcaatcctttatttaatcattaaaatcaatttttattataacgccggttgtaaaattaagttagaaaaatagaaaagccatttgtggtagacttttgaatacccctaaacaaaagaaaggaaaccacaaatgacttacacccatcttaccacaaacgagctgacaatcatcgcccattctttcgtacaaaagcttaaagcgtaccgagtggcccaaatgatcaaccgttgtgccgaaaccgtttatcgcgattatcgttacctggaaaccggtgcctcaattgctgattatcaagatcactatatgcgtaataagcaacgttgtggccgaaaacgtactcagttgtcactggctgaactcgcttatatcaacgacaaaattgcccgggggggtggacgcctgataccattattgggcgcgctgagcgcccaattagttgtaaccagcgaactctttaccggatgtttgaacgtggccagttcggcttcgatgtccgttccttgccgatgcgaggtaagcggtacccgaatggctatgtcgagcgccgcgggaaggctggccaattggggcgaagtattcacgagcgtgacaaggactttccgcactataccactgaatttgggcaccttgaagctgataccgtccaaggcaaaaagcaccgaggggcggtaatgaccctgaccgaacgccaatcgaaggtcgaaattgtactcaatgtgcacgaaaagacggctgatgcgattaaccaacacttaagtcagtggcttcggaaattcccgcggcacttcttcaaatcgattacctttgacaacggaaaagaattcgccggctggcgcgagattgccaatcaatttgaccttcacacttactttgccgaggttggtgctcccaatcaacgagggctgaacgaaaacaacaacggtcttttacgtcgggatggcttaacgaaacagctagatttccgcaatcttcctgatgaattggtaacccaactgatgagtaagcgaaataacctgccccgtaaatcactaggctatcgaactccatatgaagtattcatgtcttgcgtcactaatgagcaactattttctttctaacttaaattgacatttcgggaaattaattttttatcatcctactaatttaaaggtcaacaaaatttatccttggcattgttaagagcaaaattaataaaaaaacgaatggtcgctctacgcttaataccatccgctaccacaatacattagtcattgcttttcgttgtttctttcggttgcttctttgcaaataagtgatatacgagtcgggcaaccagtgcttgtaaaacaatcgttactacgctttgtgcaagttttcttacccatttcataattttagctcccttacttaaatcatgccttgtagttaaacctaatcttctatcactttaattatactcgtttcttattaatttgtttaatagaagtctttatcttaagattagataaaattattaattttcataataatcttcaattcatcaatataaacgcacaaaaagccctttttattcgataattgagaataaaaagggcttaaaattaccacaatgttgtcttttggctaattataattttattattaattttctagataatttaatggcttatcaacattcacctttgttccttgatactttttagcaatccattgttgaatttgcttattatggtaaagcttgactaacttcttatattctttattatcacggttcttcttagcagttgctaaaacattaatgttatccttcgtgctttgatcaactttttcgtgataaatagaatctttcaacacatttaaatgaccagttaaagcaatcgtattaccgattaatactaaatcagttgactttaatactcgtggtccggtggtatcatcaatttctttaaattgaaggttctttggattagccgcaatctcattggttccacttgttgccccaaagcccggcttcaattttatcaagcctgcactttgtaagagcaagaggccccgcgccgtgtttgctgggttattagcgatcgcaactgtggcaccatccggaatgtctttaacactcttatacttatccgaatataagcccattggttctaaataggtagttcccatcgccgctaattgtgctttcctattttccttattataagcttgcagatatgaccatgattggaaagcatttacgtcaatttcaccactagcagtcgcccggtttaaagctacgggatcagtaaagctcttgaccttaatcttcaagccttcacttttggcctgtttactatttgcaatgtgttgccaaacctggacatctgggccaatcgttccaacagtaatctcatcgttgcgggtaaacccaccattagcgcccacactaagtccagctgcaactaaaatcactactacaataccaacaatccaccagccggtatgctttttctttctcatcataactacccctttacttttgttttcgctattcgtcataactagtcgcaatagccaacgggatccgacatgtcgttattctcgagaaatccttagtcagcgtttaccaaaattattattagtcaaccacgtggcgttcaaatggcttatctgaaataccttcatcaagaatcttctttgaccattccttcgcagagaataatgaatgatcacggtagttaccgcaagattcaatcgttgttccttgaacatcttcccacttagtcttgtaggcaatttcttcaagtgaagacttcaatgccttggcaacttcagtagttgagtgttcaccccatgtaattaagtggaaaccagtccggcagccaaatggagagcaatcaattacgccacccaagcggtcacgaagcaagccagcaagcaagtgttcaatcgtatgcaaaccagcagttggaattgcattttcatttggttgaactaaccgtaaatcatagttactaatcttatctccctttggcccttcttcaacagtaattaaacgaacgtaaggtgctttaacctttgtgtgatctaatgtaaaactttcaactttagccatagtaaaactctccttttctgcctgatgaggataaatcttggaactaaaaaatccctaggaacggcaatccaaccaattcctagggacgtctaatattcattaacgtgataccaccctaatttagccttatctcacaataagacccgcaaaaagtacataaaaatactccagcacggtaacgggtgctaatcgcttgctgctaacatgtatgctcacagcatcagtctgctccaagaccatcttcattattcgtcaccatactagttctcatctttcctagctctctgtaatggcattaaataattactcatcttttctaagcaatatctaatttaattgtaattataatatccttatccttactaattgtcaacacatatttcaaaattattcacgatataacattcttaacgttttagcatcatttttagttattccgtttttgatatttcgtgggatcatcacactatgctcatattctggagcgtgggctaatccaagtgcatgtcccagttcatgttgtgcaacctcacttcgaaattctttattagtatagtctaactggttagggtccaaagttgaggttgccttatgcaaggtattcgtagtcggatcatattcagtccgggttgagccgagttcagatgttgtatagccaacaccattgtttcccgtattatttcgtgctagatcaccatcggccgcaataatattagccttatcttcgttcttagtccagcggatatgaactgctttcgtcttgttccactttttgaccgcatcacgaaaagcccattttaatttaggatcagccgtttccatataaatagtaatattctttttcttccacttaaagccttcaagcggtgtcggtgtattttctgggattcttagccggtctgcatttggtcgttggccaccattagaaaactgaaaatcattactattagaagaatcctggctaaaaaatgatgattggaagggttgagaaggcgcatctgcatcagcaaggacatgataatcgccaattccaaccatgccagcgactaagagtgctactaaaaatcgacgcatttaatcatccccattccataaagttagaaatgacaacacggttcgaggcgttcctgccagaaactgacaatccagttctgagagaaaaagccgatcaccgttccaatattaaaagcaaagattgcatgatttttaagagaacataacaagataatgataacgggcaagacaatgttaaagtatttcgtgaatttaagactggcgcgccgttttaagtagactgttaacttatcgtgtggatgaaaacaacaatcacactgttggtaaagagcatacccggcaaaggcaatcactaagccgagtaggtcaaaaccgaagcgcaggaaaatgttcatcgtatcgattccccaaaagcgccataagttcgcaaaaagttgcattaaaatactgtacggaactaaaaacgttaattcccagccaaattctttagggacaaattcaccaaccaaaaggatattaaggccaatgacaaatagtccttctgtaaaaatcgtctctgtcatgttccagcccatcatatgcataatattgacgatggaggctggccatggcatactccctaagtttgttacaatcgtcattgaatgaccaattgagtttaagacaatcgccagtgctaaaaatacataccgacgcatttttatcatcccgtttacgcttattctctatcacagtattttagcacgcttattgattttatgcgtttatcttgtcctgaatttttgtaagtatgcaaaagagagtgggaaataacctcctcgacaaggcggttggctaagctaggacgatgattagcacagcacgggctgattatcgttcgtacttagactcgagccttgtggttattttccacgttatctttctattgttcataaaagtagttgaggctgagagaaaacaaaaattttcacccagcccctattgtttcaatcagttttaaatattaatcgcgttcaaagccatccataataatgtaagacttgattgcttcacgcttatccattgcttcataagcttcttgaatttggtcaaggtcgaagctcttagtaaagaccttaccagggttaatgtcaccatcaagaacagccttcaacaatacgtccttgtcgtaagtggttactgatgctggaccaccgccgacaatagtgttgttgtagaatagcaccgtcatgtccatctttggggtatgaggtaagccaacccgaccaacgatggtacctggacggccaactttcatggcagtatcagttgattgttcagtaccaacgcattcaaggacagcatcagcaccggcaccgttagtgagttccatgatcttttgaaccgcttcgtcactacgttcagcaacattgtcagtagcaccaaattccttagcaagggcttgacggtcagcatggcgactagtagaaatgatcttcttagcgccccgcatcttagcagcaataatcgcacaaaggccaacagcaccgtcacccattacaacaactgtatcaccatcactaacgttagcaactcgtgcagcgtggtaaccagtagccataacatcagcaagggttaagagggacttaagcattccttcactgtagtcacttggcttgcccggaactttaacaagcgcccattgaccgtgttggaaccgaacgtattgagcttgcacaccagagctaaagttatcgttgtgactttggcaagaaccatcgaagcccgcgcgacaagcagcacagtgcccacatccatgagtaaatggagcaatcacaaagtccccaggtttgacagtagtgatatcttcaccaacttcttcaacaattccaattgcttcatggccagagttttcagaatctttttcaaccggattaattcctcggaagttccataggtcagaaccacaaacacaggtccgcactaccttaataattacgtcatcaggcttttcaattgttggacggtcaacatcaacaatcttcatttgacccgccttttcaaaaatagcttttttcattgaaacgacctcctttttttattattcgccgtttgtaaaattaagttagaaaaagctgataacctcgcctgtttgacatggttatcagctttcaagtttcagatttaatgtgtaaacttgaaagggcacagtacctctgcaggcgtcatgattttttatttatcgttttatcaatcgtttagcatttcattatataaaaaacggctctacaattttaagtactgatggatttaacatcagtgctttattttttaaaatttaaaataaaaaagcgaaagatggttggaccccgtcttcgttaagaaaggaccatctttcatgaacaattctatcagaactatcttaggagttaaagatccctatctcaaactagatgaaaagaactttgataatccaattgaagatcaacctaatcaaatcattgtccatctcatccaaacttatcctatgcattgcccacgatgtggacagctaatgtgtaagaatggctataaaacagttaattgcttgggaccagagcttcactttaaaccaacaatctggtcgattaaaaagcaaaaatatatctgtaaagcttccccttcttgtcccgaagtaattactaaattagcggctgttagagatattaattatcatgatcatatctctttagcgataaaacaacgagccatgatgcttctgacgaaaaatgaatcacaaagtgatttagccaaagaactaaatgtctctgactggacaattagacgagtcattacaaaccttgatcaatttttcaagcctaactatcattggttgcctcgccatattgcttttgatgattttaaatctggtcgctttgcgcccagtggaatgagtatgattctaatgaacattgaaaataaacagacacttgacattatcctgtcacgaaaaaatagttatttgcgggactactttcttcgatatgaccgttcagcacgcctagcagttcaaacagtaacagttgacttatacactccatatcgtcacttaattcatgaactcttccctcacgctataattatcgctgatcattttcacatcgttgctcaagcgtatcgtgcattaaataaaattaggattcaagtaatgaatcgcgctggtgctgccactcatgagtggcgtgcacttaagcatttttggaaattacttttaacacctgctaatgagcttaaatataataattattgaccaagacgtaactttagttacgctcaattaaccgatgttgaagttattcaccgtctcctaagttttgataatgaattaaaaaaagcttatgaatactatcaagacttaattatggcgattgctcatcgtagtaagaaagaattaaaaaacttactcgtaattaaatggacacagcttccacaagcactacagaaagttcagcgtacccttcgtagtcataaacaagaaatctataatagtttcaaatataacacctagataaacggccctgttgaaggaactaataataaaattaaagttattaaacgaactgcttatggctttcgtaatttctttaatttccggattagaattcttcttgcattaccaaatacctatatcgcaataacttggcaaaataaacaaacagctcatgccaaagtccaggcacaagctgcttagtaaaactattttattttctcatcagtacttcttgacgaagagcctaaaaaacagctgtggatttcccctctgacgtgtacccccagagttggaaatcaactctgggggtattttatatgaccaaaattagcgttaaaactaaacttaaagctgttgaagaatatgccaacggtaatgttactttagcatcagttaggcataaatacgggattgctgaacatgatttccaaatttgggtgggaatttatgcaagatttggtaaaggaccattactcaatccactcaaagtaactggggattttcggttaaatctggtaaagtggaaacaagaaaatttggcgtcaatctcagaaacttgtattcactttggatatcgttccccaggttcagtgtatcagtgggaatgtctctataacaagaaagggccacaggctttactgagattgtgtcggggaaggaaacctaaaaatggtcaaacgacacgacaagaatcaagacaagcttcttcagctccaaaaacagaaccaagctttacaaagagaaaacttattgttaaagatacaactcgatgcctcaaaaaaattgacagccttgagaaagcgtccaaaaaagaactcgcacaagtaatttatggcctcaaggctaaatacttattaaaggatttgatcgatgcacttcccatttccatgtcaacctatcagtattggcaaaatcggtttgaacatccggatgaggatgaagaagaacttaaagccgttattaaaggcctctttaactactaccaagctgaatacggcgtacgccgtttaagcactcaaattcgagactactatcgcttaattggtaaaaagacacctaatcataagcgcattcagcgcttaatgcatgaaatgggacttaaatgtatcaaatataatcggcgagtccgtaagtatgattcctctaagggaccaaatggcaagaaagctaagaataagctaaatcggcgttttatgagtaaccgtaaatatcagaaaatggtttgtgacattacagaattaaaggctcatgatgggcgaaaagtgtacttagaaattattaaggacttggcaactaaccagattcttacttggtcaatcagtcaacatccaaatcttcaattcgcattagatccactccagcaattacttaagcagttacctcatacaggataccaattaactttacatactgatcaaggctggcactatcaacatcgtgcttggcacaaactacttcgtcagggaaacattaggcaaagcatgtcgcatcgagcaacctgtctggataacgctgcctgtgaaacagtctttagtaaactgaaagcagaaattggtcctgataccagttattgcaatcaagaagaattaagccaagcaattaatgaatggattcacttttataacgaacgccgtattcagacaaaactaggcaaccaaactccacttcaatatgagcagaatctagttgatgagcagaatctagttgcctagaaaaatatttattcaattttaaagcaagaacatacaggttccaactttaagggtacacgtcactccgcagctgttttggtgttctattgggtatacactttctggtatggatggagattccatgccagatttttttatacaaaaaagaggacatttgctgtcccctcgttatacaatcaattcactacaaaaatcatgaaagaaggttaaacaaatgtcccataatgattctatcctaaatattcttggaattaaagataaaaatattaaaattatttctgttgaagaagctgaacacaacgatgattctgttaaagagtatataacactaataacagctactctttcctatccgattaatcgttgtcgtaactgtggctttcctacagttaataaggatggctttcgcaaaactcatgtacgactggctagtttaaacgggagaagatatgaattagagcttcgtaaacaacgctataaatgtaaatcatgccatactacttttggtgttattaccaatttaaccaaagaaaatcaaaccctatccagtaatcttaaaaatcaaatcatgctttgggctcgtaaaggactatctggtcagctaattgctgaaatgtgtcactgctctcctagcagtgttcgtcgaacaattttagagcgcatggaaccacactatcgtgtagctaagttgcctaagcatctatgttttgacgagtttcgttcaactaagtctgtgatgtcctttatctgttgtgacgctgaaacccaccaaattatcacaaagttacaggatcgtctatcacctaccattattgattattttgaaagtcgttattcaaaagccgaacgcgaatgcgtccaatcagttgtgattgatttaaatgctcaatatcaaagctttatctatcgccttttccctaatgccagcattattattgatcgtttccatcttgtgcaattagctggtcgcgctttggacaattgtcgtatttctatcctaaaacaacttgataaacagagccgagaatataaaattatgaagtcacattggaagctattccataaaaaagctgaagatcttcaccctgaagaagtagtttttcttcgcggcgttaagcaatatatgactcgccaaaatgctgttgatctcattactagtaaattttccaagtttgctgaagtataccaaacttaccaagatatcacgaaagccctaaacgagcgcaatagtgaattactagagtcaaccatcttagactaccaaaaaaccaatacagaaatggataccgctatccaaacccttcgtcaaaacagaaaatatgtcttaaatagtgctaaatttgaatactctaatgttcctttagaaggcatcaatcgcaaaatcaaaactctaaaacgaacttgttatggttttgccaatcaaaaatttttctttttaagaatcgattgtattttttcgtaaaaaaataccccctacattttcgtaggaagtatttttagtcaaccataccagttgacagatatccgttctattcagcaagtctaccgacgactggcagatcctttaatacccgtttaccatggggtgacttttcaagcaaaacgtctgtcaagtcctggccggccaagtttccatggtggcggccaccctgccaggctggtttagcagagacgtcatagattacaccttcaactgctacgtaggcaggttgaccagcttggccattgtactttgctagttcatccctcgtcattaccttatcagccatcatgatgacctcctttaattttggtaattaaaccgtaccatgaaccctggctctttgtcaatcggtaaggatgaagagaatttggagaactatactaagctactttggcttttggtctagttctcttttttgataattcacggatcatgagattagaagtcttcaacgaaataagaagcctaatccgaaaatggaagaagttgcgatagccatatgcggttcgttttattatcttgattttattattagcgccttcgatcggcccgttggttagtaggatgtaaaagctggcaatgatctcctggcggtgcttggcaagggttcgcttaactcgtcgcatcgcacttggtaaattattccgcttgattaactgatctaacaaggcctgactgcggttactaatcgtggctattaagtcttgatagtattcgtaggcagcccttagatctggagagaaatcgagtagccgttcgacgacttcttgattggataaccagtgatattggaagttacgccgagaataacagtgtaggtaattaagtaagggtccttgattccggtccaaaagttgatatcattagtcatgaggaatatatcctttctaagacaaccgaggtagttatggggataacatagaacggttgtctttttttgtttcgccgtttgtaaaattaagttagaaaaatagaaaagccatttgtggtagacttttgaatacccctaaacaaaagaaaggaaaccacaaatgacttacacccatcttaccacaaacgagctgataatcatcgcccattctttcgtgcaaaagcttaaagcgtaccgagtggcccaaatgatcaaccgttgccaagttttagcgcgttataaagaggggattaagtgtggctttgagactaagttctcaaatggtcgaaccgaagggattaataatcgaattaagactatcaaacgagttgcctgtggttatcgttactttacggcatttaaaacttggatttatttaattattggccaccaaattcaaactaactaaaaagaaccgtcacgaatgacagttctaactagaccaatttaattggcgatgattcatatttgcgtatcaacactacttgacgtagagccaaaaaagtccagccactcaaattgagtttgctggaccattatacgcgaaactaattttagtataacaaactaaaggatctatttccaagattatttagtagattctgttgcgatccgttcaaaattgctttcaagatccatattagtcgtcggatgacaatctggatcaccgttatttgattggtcaactaacacaaccggtttaccattatggaaggcaaagaagtatgtaattcgatttggcaatggcggttctgtcccgtcatgattatagatcgctacaacattatattcataatcacccttgcctgatggtgcccagccaatcaagccagactgaccttctactaattctttgcttaaaccatcggggtatgttattcctgttgaaaccttcaattcattttgaccatcatattgttcataggattggtgcattgttggtccccatttttgcataaacgatgccaactgctcattcttttgattattccacaatgaactatcgtggtgcgattcactactgcttgtattattagtagtggcagtactttgactactgctagcttctgaattagtctttgcggtattgctactgctttgcgtgctttggttgccacaaccagttaaggcaacgcccaaactagcaatcgcaagaacttccattaattttttcaattttatcctccccaaacgtaaataaagaccagaaagaatgcttccctcttctttccagtctacctattaatcttcaacttttttagcgtcgttcattgccttcatgatagaaggattctttgaatgacaatccttgatcatttggatatcttcttcacttaattcaacggtgtatttatccatgatcttccctcgctttacttaaaaaattacacccttactatatcacatcacaggagcagtgtctggcttaatcagtaaattaagatcattaattgacattcaactgagatttgctaagattaacattgaattgcataaacggggagcttgcagacaggctgagaggggactatgcgtctcgacccaatgaacctgatttggataatgccaacgtaggaaggattaataaaggacgaccaggatcaaagtgattactggtcgctttttactttgcactatcttaatcaaatcaaacttaaggatggtggaattatgcaacgacagacaacaattatcgaaaacagcatgatttggtgtggcgccgggatttcaattgccgaaatcctaactgggacttacttagctccccttggttttacaaaagggatcgccgtaattatccttggccacattatcggctgttttctgctctttttagctggaattattggcggtcagcaacgtcttagttcaatgaacgccgcaaaaattagttttggccaaaatggcagtaagttttttgccctattgaatgttctccaattgatcggttggaccggcatcatgatttatgatggtgcattagcagccaatggggtctggcaccttaatcaggcattatgggtcattttaatcggcgccctgattattggctggctgctcgtcggggttcggcacctttattaccttaaccttgcgaccatctcaacattattaattctaagcggtctcctatgcgccgccatttttacccatcattctaccagttcaccaactggtacattgtcatgggctcaggggatggagctagttatcgccatgccattatcgtggttgccacttattagtgattacaccagtgttgctcaacgacccgtgccaactagcgggattagtgcagttgtctatggcctgactagttgttggatggccttcatcggtttaggagctgctatccttactcatgacattaacatcgccacgattattttacgggccggcttgggaattgccggtttatttatcattattttttccacaatcacaacgacatttatggacgcttattctgctggtgtttcttcaaaaacgattttcaataaatggtcgggaacaatggccgcaattggtgcaactattctaggaacaattagtgcattaattttccccatggataacttcagtaattttctttaccttattggctcagtttttgcaccaatgattgcgattcaaattacagattacttcattttgaaagtagattatcgtcaacaaaattgccaatggactaacctaattctctggttgattggttttatcatttaccgaattctgctaaattattcatttccgctcggcagtaccgttactaccatcattgtcatcatcgcaatgacatggggcacctgtcgcgttatgaaattagttaaagcaaaatagttaagctaaataattacaggaaaagaatattaagttcatttgtcctaataaccgtttagggcaggtagactttttattttaaattcagttcaaaccccatatgtttattgtcaattttgtcatcagtataaatcgttccgcgttttataaagccaatctcctggcctattttttgaacaggaatatttttgtaatgagtatcataacggaaattccttactccctgcaaatacccaaccgtaagtaaattggagaagatatatttcccaaaaccttgaccattgtgggaaggaaggactgctaatcgatgaatgattgcatatggctcatttggttttaaccacgatccatctttaatctcttcatacgtttgttccgaggttagttgtaaggtagccgtcccaacaattttttgattatcaattagcacccagttatagccagctttaatatcattttccatcgttttctggaaaggatgaccatcttgccattgtggattacccttttcttttaattgtgctcgtgcctgttcaataattgtcatcacactttgaagatcatccaaagttgctcgtcgtaagtaaattgccattatcttttctccttaatcatctctcactcctaataacaaaattctaatatattaatgtatggtcattttatcacgattaattattaaactgatggggctttagctaagtttaagtgttttgtcacagcgttttcattttaaggagggaatctcatatttatccataataaaaaggcctcctttagaattgggagacccttttatttaactttatatcatctaatttgttcaaacttagtcgctttatgatcaattccttgaccggcattggcaatctgataagtaaagttaccagaccgcatctttttgcctaatgctagcatatgattatattgccacattgagactttcccatcttgcagttttgaaagtgtcaaccgatttccttgcgccttataattccacttgccatcttcggcgttgtcttggtaggcttgttgaaaatcgctagcactattacttgctttgattgccgtatccttgtcgggagtaacaacaacctgatccccacttgtggcaaaggtcatataagcattctgattacctgacactgatgtatattcataaacgtgaccaggaaggcgtttagccactgtccgactagcatagagataaaagccgccaataacaaccattactgctactaaaacagaaataataacttttgtctttttttgcatttttatcccctattactcatcgtcagaagtgtcggtgtcgtggtcacttgtagtagcttgactgttgctatcttcatcatcactgctgctttgactgctgtcatcgctgctttcactttcgctactactgctgctatcgctatcttcatcatccttattgctgctactattgctgctatcagcgtcatcattaacactagcgtagacatggatctcgttgccatctttttcaatgtaaactgtcgtatccttcttggcttttgaacctagggcactttcgatttcactaaggatcgcatcatagtcattcttcttagcatcctttaagatagctgctgaatcaacattaagttcatcagcgtcactacccccatccccttcgtcaaaggacagtttgtcattattattggcatcattcaagccgctcacaatgtcagaagcactgactgatgaagtatgcttctgatgcttagcagacttagttgagctggattgactagcactttgttcattatcattgtcgttgttgttaaatgaatttaccgcgcctgccttgtaaattgttgtcgaatgatcagaattgtcggaattatcgtaattcttaacaacagattgtggttgaacggcaatattcactgttgttgggccattattgattgtaatctttgtctgggcaacaacattcggatttacgttgggatcataaccagcaggaacgcttccttcacggtttaagataagaacatccccagcaaagattaaattagcattttgaatgttgttatcgtagcaaagtttagccacagaaattccagttgcggctgagatccccgataaagtgtcaccccattgaataatgtaacgagtgccattaaggttattggtattaatgtgttgcatcgccatattattagaaatttgttcgggggtattggcaatccaattagtaatatccgcttgctcttctggtgatccactggcattatcagcctcagtagttaccacagagccaatcattactgatcccgctaaaacagcagtcataaaagtagctgctagttgcttcttacttaacttcatagaattatcctccctaatagtatcaaacctattaatacagaaataattttactgctattagaataattcttcaaatgcaggtatgaccctttctatttggcgctggttttaataagatagaacgaaccaaaaacggcaaccaatgcatagattgccccaacatacccaatctggttaatttgaacaaaattgatactgatcgatgctgtcaaggaaccaatcgatactcccacgttagtacaaattgggtttaatgaagaagccagattcattgcttctggatattcccgatcagcaatgttcagaaacattacttgcagaattgaaccgggcattcctagaacaaaacaaataacacacaataacagaattcctaaccatgcaacatggaacattgcattcatcaacaacaaacaaataagaacagtactactaataattgtaagtttagtgatcccaaaacgatttgcgattacgccggcacatatattaccaagaataaacgtaattccaataagtcctaatagccatgttaagttagtcgtactaaacccaagaacattggtaataatggggcgaacataagtatagaaagtatattcagcggacattaatgttaccattacgataaccccaagaattattcgccgatccttaaaaagttgaacttggttacttaacgaagcattttcttgacgactgtcccgtggtgtcggccaatataaaaagccacaaataattactgttaaaaccgaaatgagggcaaaactatcccgccaagaaaaagcattactaattgccgttccaacggggacccctacaatcgtagcaatactaaaaccagtgaaagttgaagcgaccagcattgcccgtttttcaatgggcgcaatcatacttacaaatacaagaatcaatgaaataattgtccccgcgaccgcagctgttacaatccgcgaaacaaatagccaaaataggttaggcgcaactgcggttaaagtgttaccgattaaaaagattagcattagcaccatcaaaaccttaaaacgatcaaacttacctgtcaaagtggtaattaaaggcgtgcagatagcataaataattgcaaaactagtaactaaaaagccaaccgttgataatgaagcatggtaacttttggcaatatcagaaataacccccacaatcataaattcattacatcctaataaaaatgcggttaagacaaaaacaacggactgcaagcgaaatttagacatatctttagctcctttcgtataaataaaattaaagaacaaacagcaacaggtttaaccgaattattggatcaagctcagttagaaaaagatgacctcgtagtgttaggtctttcaactagtgaagtccatggcggaataatcggaaaggactctaacattgagattgcctgggcgattgtttcgacagttgttaatatcttacgaaaacaccaactccatttagcagtccaaggttgcgagcaccttaatcgggcacttgttgtcgaacgaaatgtagctaaggagcgcggctttgaacaagttactgtcttcccttcgctccatgcaggtggtgcaggacaaattgctgcttttgaaaactttaacgattcgattgaagttgaacacattactgctgaagccggcatggacatcggtgatacctcgattggcatgcatgttaagtttatccaagttccagttcgcacttcgataaaacaaatcggactggctcatacgacttatctccgcaaccgaccaaaattgattggtggtgcgcgcgcaaaatacgaataggatccgtttgacaataaataattttaattatgaggctgcgagaaaactttttcaacatcctctttttttatacgaatcttgttacgatatcgtggaaatccttgtagactagctttgcattgtagccatccttgcgggagtggggctaaaaactcgcaagcaagtttaattctattccctttttcgttcaattatttaactttccgattacccaattcccaaaaagcgagggccgaggcagccgccacatttaaggaatcaacgcctgtagccatcgggatcttaattgtaaaatcactctgcgtaattgtattttctcttaatcccggcccctctgaaccaaggataatggctaatctatccacctcagctaactgaggatcatcaatatcaaccgtgttatgacggagcgccatcgcggctgttttatagccagctcgatgaagaagatcaactccttctgactgccaaactttagcatcaacataggtccacggtacttgaaaaaccgttcccatagctacccgtgaggcccggcgataaaggggatcagctgagtcgctcgttacaattaccccatcaattccgagagctgcggctgagcgaaaaatcgccccaatgttggtgggattaacaacactttccaggattgcgatacgcggatggtcactgggcatagtagccaaaaaattatttagacttggccgtttgacgcggtgcatagctgctaatgctcctcgtaaaagattataaccaccaccagccaactgccgaagtaatttactattaactacataaattggcgtttgttctaatcccctagtttggttaattgccatctcatgatccaaatcagccaagtcgcgctctagttccttttcttctattaaaagagatgctggccgataacctgctcgtaaagctcgttcaatcactttgggactttccgcaataaataaacccggattaggttcaagagcatgaaaaagttgtgcttcattaagtcgcatataaggatctaaatctgatcctgtaagatctgtaagaaaaattaaattatgcatattgaatttaccttatcttaaaaactgaattagtttagtatactcttattttcgatctttttcatgacggttattttataacgagtttcgtttgccgattagtaataaaatcacgttgaatcaaaagagaaacaatcattgctaaagcatcaataattatgaaaacaattaaggtgacatagtaattgtggagaacttggtgtgtgtaagaaagaagaaggggtcccaccatcccagcaattgcccaggcagttaagatatagccatgaatagctccaagttcttttgttccaaaaacgtcaccgagatatgccggaatcacagagaatcccgccccataacaagacattaataagcacaacgctaacgcaaagataaatggcgccttaaataaaagaagaacaaagagcatcacaatatcaagaacaaaaatcaaactataggtaagtggccggccaataaaatctgataaagttgcccaagctagacgaccaaaaccattaaatagaccaatgataccaaccattacggcagccgcactcgctgtcattgtcgtcatgtcctgggccattggtgaagcagctgaaactagcccaattccggtagtgatattaataaaaaacataaaccataggaaagcaaatgtccgtgtccgcaaagcctgattagcagttaattcgcgaccagtcaaacttatccgttcagcattcttagcaatcgctggagggagttcatgtgatcgtggcttcttgataaattgggcagcaaccagcattacaacaaaataaaagcctccgagaatgtagaaggtatttacaacgccaacgttcgccattaaactttgcgcaatcggccccgtaagcatcgctgcaaaaccaaagcccataattgctaaaccagtagctagtccccgcttatcgggaaaccaacgcacgatagtagaaaccggggttacatatcctgaccctaatcctaagccacctattactccatatgcgacatataataaccataattgatgagactgaatcgctaatcccgttaaggcaatcccactcccatagcaaatacttgaaatagttccagtaactgttggcccaaatttttctactaaacgccccataaaggcagctgacatccccaagcaaaagatagctaagctaaatgcaaacgatactgaagtttccttccagcctgtatatccagagattggtttggtaaacacactccatgcatagacactaccaatcatcaaatgcaaaattactcctgcaatagctactccataacgatttcttgttttcggcatcttcactactccttctctacataatttacgaactttttaataaattaagctctataagttcgtctatttaaaaatatcatagagcaactaacttatcaataagaaaaaaacgaacaatctaatttagcgatagcatttattactgcttgaaacttacctttaatagtaaaaaacacccagcttttacactggatgtttctcattggcaaatatgttgtttttaattgagttgacttagttttaaaactaccaaagtaccatcatatcgcagttccaactctaagttacattatataattctattcgtattcaattgaagatgcccctttattatccctataatatcggcatttctagagtcatttcctatttttggtagggttttggtaggattatttggttgaatggagatgctgatttccattaaaagccaacttattttctttagcatttttgaaaataatattaccttccattttatcagcaatgctttcatcattatgcggccataaatgcgaatagtacttgagtgttatatctggacctgaatgcccaagtcttctggaaactgttaacacatcagcattaaactcattgattaaataactaacattactatgtctaagtcctttagcctgaataggtttcacaccagcaatttttgcaaacctcttaattatcaacggaattgtcgttcgactcatgggggtatcatcataggacattataaagtgatatacaccatgagcttgttgatctttttgccaagattttaatactcgaatagtgtcgttgtccaacgatatcgtcctaatgccatttatagtcttggtgtagggctttattgtgtaatgttccttattagtcatatcaagcgttttattgattcttaaacgatgccgtttataatcgacgtcatcatatgttaaagccaacccttcgctcacacgcatcccacatgtgaaatataagtataaaatagtaaaacacatgtgttgataataatctttagtatatatgacagaaaggactttctcaaattctgattttgtccagaattcaacattagatttacctttattaatagccttggtcttacgagaaggatttttagtaagaaaatccattcttacagcataatctaacgtattacggaacaaaccataaaccatgcttgaaaaaccttgagaataaccacttttattgagcaaatatactctaaatttctcacagtcaatagatcggatacttcgtaacttatattgcccaaaccaatttattaaatgtttaaaaatactttgacgactcttaaaagtactatgttcaacatcagatttataagatggaatatagtaattctccataaagtcaccgtacaagagtccgtaatttgcgtaaccattctgactctggtactcattctttatccttaagcactctttatatgcatcatgtgcagatctaaacctattattgttggcatctcgtcgacttttcttttgaattctttttcctgtcaataaatcatggcctaattcaactaaataatagtaatgacccttattgtctacataaacatctggatatttagtctttgccaatactatcattcccgtcttttaataacggaaacccaacaattttttcaacagcacgaactggtacaacaccaatccttttcccattgtataaaggcaaaccttgttccacaagattaattttagcttggtgaatgatatcgcgtgcctgatgttccttgaatcctagtcgaattaagtctttataattaaccattggtttcatgctaaatatcccctttgttcatgtcataacgatagctttccagctttttaatttctttttttaactcgtcaattttcttatccaatttatcgtaagcgttaattggatagtacatgccaacaatacagtgatcaccattaatcacattaattggcaattgtttagcatttcccatcgcatttactttagaaaaacacttcaagaacaactcttgtctaacattcactgcttgtttattttgatagtccattaccctttctcctaacattaatcattaaagttaaaaggaacaaatagcttagaattttgtttattcttgccttgttcttcacggtagatcacaaaattctcatgccaatgttgtaacgtgtacgtatcatcagttgtttcataattgaataatttatcgggcaaaacggcatattttatgagcatgtctttcattttcccattatcaagggccttattacctgacacaattacgttgctataatactccccgttaaaatgcttgcgttggaacttcagtcctagcgatttaatttgatctttaaaagtgcggtatgacgcagtaaccatatgagtgtggtttttataggtttcaaacaagtcacttgtccccatcccaatcagatcaaacgggcacgtaatgtgttgcgcttcgagaaactccaaaagtgatgaattaatgtttgacaaactactttgagcagaattctcttggctaaaaatcaagcctaaatcttgtttgctcatagttacgagcttagacgcgtatttgatgataaggtagaacattacttcttgaacttctttattattaatccaagctgctgcatcgtcattggggatgtcaacctcatcatatagctttgtattacaattaaagacaaacatgcgatctgctgtacctacttgacggatctgagggagagcattggtagcaatcacaattaatgatggcagttttacgtcatggtactgttggaatttggcagcaccagacattgtcttaccactaataattccattgattgcagttccagcctttgagctaatagcattattctgtgaatctgtctggaagtcgtcaaaccacaaagtaagttgcccttttttagtgtcatttgcatcgatcagattaggatctgttaatgccttattaatatttgactctgaagtcaagatacaagaagtattattctgcgtattattaaagatcttttctaacaagcttgctaagacagtttttcctgccccaggaacgcctagcagaatgaagaaacgacgtaccttagccagaattcctgtgttttgtaatgggataaatccaagcatatataacagttgttctagcttgccaccactaatatgcgtcaagaattggataacttgtttatattcttcgctagctttaagcttagaatccttatcaatgtcaatataatcaacgttgacatagttttccatttttcctactaaaggggatgcaatttgaatattgccatcttcttcaatcatgatagattggtggggtgacttaaagccgtcgtctaaaacttcattttcaaattttgaatcaactaattgagcgtgaacattttttcgagcattaataatgttatcgaactttgaatttggaaggaattgatcaatcaaactgttaacaatagttggttcagcagtataaatatgatgatcattcaacaccataagttgattatcaactagtagtgaacgtggatcgttatatactttctcagcaataatttgcttccttaaggcattgtatttcaacgtattatagagttttttagctaacttattagcatccatatcatgctctactgcccagatctgtagcaccatggctagctcgttatataggtaagtattcttggttaggatatctttattcttatcaataatattatccaaccattcttcaatcttatcgtcggtaatagtagcaatcgtgattggcaagctgtcaatcaagctaaaattagaatgtaattttagaaactcatcaacatcatcaatttcatttgccaaaatagtttgcccaaacaaattaatccgatcagcaactttagtcttagaaataaacacctgatttaccaacgaggctttcgtgaattcattaatataagatttaacatccttacttttttccttgtcgattgagaaagcatagtagtactctttaggcaacttactatcaacatctgcaaaaccagcatctgttaaaattgcatctaatttcttagaaatcttatgtagtgccttgacatcaccatttagtttgttgttttcaaaaaaagatccttgcataattttacgctctccttttcaatccgttctgcttccaacaatgctttttcattaacactaacagtttcatcttttagtgattttcctgttaacaattcgtaaacaccattttttccaaattcacgattacggcatttataatcaccatcgctattaataagaaggtattccaaatcatttttcacaaggcaaaaatcatactgtttaactgaaaatgttaggtatttgactttcccactatatttgtccttaaattgttcgaacttttcttcattaaagttggtaataatgaagccatcattaacacaattaatcacgtttgataggccccaaaagttgagcatgtcgaaaaccatattcataccaccatacatagctttatagcgattaatactgtgttctgtttttgtcttgccaatggttgaacaatacttgtttaaccattgctttaaccttttcctttttgaaacaagtcgtttattgttaggataattaggatctgcctcaatctctttcttttccaaaaacattttttcatgccgttcatctaataaatccaattggtaagccattgttagtagcaacgaatgaacgtcaatttgtgcaacgttacgtaccatgcattttcggtatagataaataccattaccagtaaaattaagtcgttccttttgataaccttcatacggtcccgtcgcaaccaaagatgatagtaactgtggaggcagtaacttaatattttcgtgctcttcatccatagtttctggccgatgattaaaatctggcgttaaatgcaactgttcagccatcaagaggaaccgaggagtgctaggccaatacataatgccatttttcttttttacttttttcaaaataaaataccccttttcaattcctgcttaacagcaaaaccgaaaaagggtatactaaacttgcctttatttataataaaggttataatagtaatatataaatatatgcattggtagtgagtatatttatatagtttttcagttttaaactgttaagtaggttaaggttttcagattttgctgcccggcgatttctgaaaccttttttattttgcaataattattaaataattattgttatttatataataacccaccagttcgaaaagtaaatggcttttgcttgactatttatctcattaattatataataataattaagaaatgtaatacaggctgttattatgcggttttcagcttgtgataaaagagcaaatttcgtgtaaatattttattaagattctcttaagacaataatttccgttcttcaagttagaagaacggtttttgttttggcagattgcaagaaataacttgaacgaatttaatgacgtaaattaagcaggaagatctcgattggtgtgcgccagttaagacatttgagtggccgggaattcagataccaattgatttgaaccagctcgcgatcgctcagctcttcaatagcttgtcccttgggaataaatcgtcgcaaaactcggttacggttctcattactaccgcgttcatgtggtgaataagcatgggcaacttgttcaggggaccacttctggacttgaatcttttcctcgaccaagtgtttaaggtttttagtgagcgaagacttccgcccccgttgactaaccttttgttcaaagtcagtttgcgctagctcagcctggtactcactatttagccggtgaagctcattgaagatagtggtcttactaaagcctaagtagttagcgatatactgcaaggaacgtttctcgttatgaagtgtttcgatgacaacgcggtctgaaaatgataagatagtggtgcccataaaggtccttctttcaatggaatgttgtggtaacaccattaaagacctttatgggtttttctgtccacttaatgttcaacttaaattttacaatctgccataactaaaaagaggccgggaaataacccgacctctttgctattttaatgataaaaatgcagcggctggctgtccagtcatcccgctactcgttattcaattgttatcgcaaaaccgtctggagccagctggtgcccctgcattccctgactaagaagcagttggcccctggttgctaactccgctggtgcgcccgtagtgttaaagaaccctttaagcactttcccagcacctgtacgggaaacttccaccaccccgattggcaggacattaaatgcaattgtcccgcctgcaattaggtcggcatagtcacgacgtaatgcgactagcttcttaaaatatgcaagcatttcttgagcatcatcgtcaggcgcccagttcattggcttccgacagtccggatcattgtctccatccatgccgtactcggtgccatagtaaattgacggtgttccaggctgcaagaatgtaaaggcaaaagtttgcttgactaggtcccggttatcgtgggcctgagtcataattcgcgctgtatcatgagaatccaagacattaaacatcatctgattagtctggtcacggtacttcatcagctggttgctaagctgatcaatcattcgttccgcactaagccggtggttgatgaagtggtccaaaatagcaccggtgtagctgtagttcattaccccgctaaattcgtccccgttcagccacgcctgcgaggtatgccaaatctcacctaggatataaaaatctggtttgagggccgttgtctcctgatggaacctcttccagaagtggtggtcaatttcattggccacatccagccgccaagcatcaatatcaaattcttcaatccaatatttggcaattcccaacaagtaatcctgcactgctgggttagctgtgttgagtttcggcatatgcggtgtgtaatcaaaggtatcgtaagttgcatccggggtaaattcaaagttcttggtcggcgtgtaagttgctgggaacttattaacatggaaccaatcagcatatttcgagttttggccgtttttaaggacgtcctgccactgtggcgacttatcaccaatatggttaaagacggcatctagcattaccttaatcccccgcttgtgagcctgggcaaccacttccttaaataaggcggcgtcaccaaagtgaggatcaatctggtaatagtcttctgtatcatacttatggttagaaggggctttaaaaagcgggttaaagtagatcccattgacacccaatgcttgaaggtggtcaaggtggtccagtacaccctgcaagtcaccaccatagaaatcctgacgaccaggatggtcattggcattccactttttagtaccagcagggtcgttggactgatcaccattggcaaagcgatcggggaaaatctggtaccaaaccgttttctttacccattctggagcatgaaacatatcaatctcttggaagaagggcatccgaaagtaggtatttaaatcattcaaggcagcgtggtcatctggctgaaggtagccccggtcggtataaaccgtcctcgtcccatcagcgccagtgatgtcaaaggcatacgccaagcgctttttcggctcggtaaccgcaatctgccaataatcatagaggtcatctgacaagattttcttcatcggcgtcggtttggtataaaatggcggtttaattcccgccaggctgcgaagactgtaagggtcaccgtgcaatagctggaccgcttttacgtcatctttagcagtccgtaaacggatatgcatcgtctgagagtcataaagaaaggccatttcgctttccggccggtggtagatagcagcaagattcatcattcaatatctcccttttcaacagaggtttccttgacaacgtaaaccgtaaatgccccaatcagtgctaggacagcagatacgaccagcatgtgtggaatgtagttgcccaataacggataaagagcaaaggagcaaacagaagcaacaatctgtgggaggcagatccagcagttgaataaccccatgtaagtaccatcatgcttaccatccagggcattcgtcaggatagtgaacgggatggagttgatcgtaacccagcacataccgataccaataaaagcaacaaacgataatagcttagtcggcgcaacagataagccccagaagccgagggcacccaggaccattcctaaggcgtaggcaggtttccgaattcggtcattcagcttttgcaaaaccaatccgtaaataattgctaccccgacttcaacagcagacaggacaccaaaccagtttccggcagcttggtaagcagcgctagaagcattcgtagtgtgccagatgttttgggccaccgtccctgcaccataagtccacaggtattggaaaccagtccaagagaaaaattcaacaattcccagcgtccagaaaaccttgggcgcgtgtttaacaattgtgaagaagttttcactaatattagcattttggtctaagccgtggtacttggcataagtctctgggtcatattcgtcaactttccaaatagtaaagattgatgaaacaactaaaatcgcagctccaatatagaatgaccacttaacagaatctggtaattcacccttagctgcaatattcttaaccccaatccaggtcaagaaaaacgggaagaggtcagcggcaactgacccgatgtttccccaaatcgtctgccatgaccaagcctggtccttttgttcatcgtttaccatgtcagaaatcatcatcttgaatggctgcatcgacatatttgaagacaggtccataaataggatggttaccgcgccgaaccatagcgcagtcgaagtcttgaaaccaaacgagccggagttcggcaacaggcacatcacaatgacagccacaatcgtccctaaaatcaagtaagggagccgccgcccaattttaggaatccaggtccggtcggaaaagtagccgaccagtggttgaacaaccatccctgctaatggcggcaggatgaaaaaccatcctagcttggttgggtccgcccccagggtttggaagatccgccccatgttagcactctgcaaagcaaaggccatcgaagtccccaggttcccaaacgtcatcagcattaatactgaaaacgcgagggacggcaaatttttatttaactttttctcgctcatataatagcgcctccatcaataattaataagtctataatgattacgcttacataatactgctatcggccgcctattgcaaccgcttgcacaaaattattagcaaccgtttacttttaaaagctgacggtcccttggactccctaaattcttaccgcacatttgcttttttaaggtaaactgacaatccatttaaattttataaaagcttagttttagttattcaaccactttataaaaccggagttttacaaagcttattacgaaagattatttttccttactcgttaatttttcgtacatttcaaatagatgctgtacaatctcctgctcagtagctgatggctttaggccgtatgctttaagaacagctttatcattagcctcatgtgctttacgaaattcgactggcatcgttaatggatcgtagagatcggcaagagaactatctgggtaaagtttacgggcatcaagtattccctgggctgtttttgaaatttgttttctagatttgtcatctaaattaggccaaggaaaattatgttggaaaaatcttactaacattgaaagattttataaaattaactggaaagatgactatctacatgacttattagtcttttttgatataaaacagattttaccatctgaaaatcaaatgcagctttacatagacaacaacggtaatgttaatagtattttgttatatgaactattagtgtatgaattacaaaagttatcactaaccgaaataactactttgaagcattatattgagctaaaatcttctaaaaaagtctatcaaagaaatataacacttaataatgttagtaaagtaattctaatagttagtacaattgctcttatccttaccatatctggaactaatgaagatattacagtcggtaatgtcactgttaaaaattttaacactaaagttatcacgcatcttattgctcaagttcctgttattcccataatatttagcctgcttattttaatattagttacaactatttttatttcggtcgcattttataatgcaaaacatttaaggtacgcggatgtcattcaccaagctctggaggatgcatcctctatcaaagctaatattcaccataaaaaataatgtttcaacatattctttatattgatacatttctttttagtttaagtacaatcagttcactatgattaatgaaatatggattattaattaaagataattatattatttcctaagcataccctatctatcatttttacaaaaaaataaatataccgcatatgtttctaataaccttctgacaatcaacgatacaaaaaaaggtactacgtaagttcaaattacagagtaccttttaccgtattattcgctgatgttttctgtagagagtttgtgcctaactttctttttctactaagctttgtctcactactaacaaacaacgttataataagttattttacttaatctaatgctcaaccataggattagaatctttaacctcatcattatatttgaaaacttaatagcagaaacagatattacgtatattaaatttatgtggtacctgttttttctttatatattgcttttataggctcttttaagacgatttgattaatttatcattaagccctcaaagtgtgctcatttgaggcttattttggctctcatgagatataactagtttttcaaaagaagtaaaagacttcatttctcgcttagagagatgaagtcttcattttttatgtcagcctttttatctaactattttattaaatttggtgtatttttggtgtatatacaccctaatttctaatcttataaagaataacatcagaacttgcaagtagttttagcatattctaaatgcctttatatcaaccattcagtttacttcttcttgttcttctttttctttgaatcgttcttagtttccttttccggacgcatcgttgggaaataaagaacatacctatcttcacaattaagtaaggataatatacagaacctgtaaagataattatattattacttatagctaaaatatgtaattttaaaacaatggcgtgccaatgtaataacaaaaaaagtactacgcaagctcaaattacgtagtaccttttgcggtattatctattgatgtttttggtagacttttggtagacaacttgcaataaactgccaattctaccaaatttgaacctctacaaatgccgttatcttaggcttccctcttcatattgttctataacattattcgtattcgatcgtcgaaggtggcttactcgtaacatcataaagaatgcggttaacgtggtcgacttcatttacgattcggactgagatcttttgaagaatatcccatggaatcttagcgaaatcggctgtcatcccatcaattgaggtaacggcccggatagcaactgcatagtcatatgtccggccatcacccatgacaccaactgaacgaatacctggtaagacagtaaagtattgccaaatttcttcatcaagacctgcttttttgatttcttcacgaaggattgcatcactttcacgaacaatttcaagcttttcaggagtaatttcaccaataacacgaattccaagacctggacctgggaatggttgacgccataccaattcatgtggaattccaagtttttcaccgagttcacgggtttcatccttaaagagcttgcgtaatggttcaattaacttgaaaccgagcttctttggcaaaccaccaacattatggtgagacttaattgtctgggcggtgtctgttccagattcaattacgtccgtataaagcgtaccttgagctaagaaatcagcatctttaatcttcttggcctcttcgttaaagacttcgataaattccttaccgataatcttccgcttttgttctggatcggtaacaccttcaagcttacctaagaagcgatctgcggcgtcaactttaatgatgttaacaccaaggtcgcggctcaacgcatccattacttggtcagcttcgttcttacgtaacaatccgtggtcaacaaagatacaagtaagttggtcaccgattgccttgtggatcaaaacggcagtaacactggaatcaaccccaccagaaaggcctaagataaccttcttgtcaccgacttctttgcggatttcatcaatctgcatatcgatgaagtcatccatcgtccagtttgctttagcgccacaaacatcaaaagcaaagcggcgtaaaatgtctaatccatattcggaattacgaacttcagggtggaattgaacaccatagaatttacggtcattatcagcaatcgatgcgattggacagttcttactagtagcagtaacttcaaaaccagctggggcttgagttactaaatcaccatggctcatccatacatattgcttctttggcaaaccttttaataatacagcctcgtcatcaagtacttcaatatctgctcgtccatattcggagttatcagctttttcaacctttccgccaagatcgtatgacattaattgcattccataacaaatacctaagatcgggatcccaagcttaaagatttctggatcgaccttgaatgcgtttggatcataaacactgttagggccaccagagaagatgatccccttaggattaatctctttgatctcgtctgcagtcaacttgtgagaaagcaattcggaataaataccgaaatcacgaagccgacgagtaatcaattgattgtattggctaccaaaatccaaggcaatgatcttatcaaacgcatctaaattgatgtttgccacaatgacacttcctttgttcaaatttttattcttaaaggctagtttacaggctgaacatggcatggtcaatgattatttaatattccataacaaaaaagacgggagccaaattttctcacgcctttttcgttagatggaattttattgaggatatttaattagtgttctaaatcaatatttaatagacgtaattcttcatcaaccgcttgtgcttcaagtgttttagtatctttatcagtttttatcatttcgacagcctcctcatctcatttaatctgtatctttcttaagtggtctgtcagtaattgtcaataaaaatgagtcataaatattatatgcaaccgtttcgaaccttggtatattaggattaaaaaggttcatttttttacttttactaagggctttaactaaattttctagtgcaggatttgtaatccattccaaattcagttggtttgaatacgctttctatatttgataaaatttagttagctatttttacttgaggtacaatatgtttattcggacaaaatatcttaaccaactaataaacaacatggaccggccaacaattaagatcctcgttggggttcgtcggtgtggtaaaacaactattcttgaccaattccgagcaactcttcggcgccaagaaatatccccaagccaaattcaggtgatcaactttgaatatctcctagaaaatgaattatgcaatccagaatatcttttacaatttatccttgatcggcttagtaaacaccagatgaattatatttttctcgatgaagttgaagtggttccccagtttgcccgcgttgtcaatgccctaaattcactctccaatactgatgtctatattacaagttccaacaaaactattctggagaaagaaaatcttcaacaaatgactccctacatcatcatccccgttttcccttgcagcttccgtgaatacataaaaaggaaccaacaagaagctgattcccaaacgttatatcaatatttaaatgagggtggtttcccctatactcacgaaattcacggtccaatcaacctccgtaattatgtgaatgggatcatcaacacgattatcattaccgatttcacccagcaagcgaccctttgtaatccaggactaactaaacaactcgcgcatcacctagctcatcacgccggaaccacacaaaatatctctcagattgttgatagtcttaaacgtcaccatatcactacttccaataagacagtcgatttctatttgcagttcttacagacgtcctttattttttacccgtgcaaagagtatgatttttctcgtcgccacgtcaaaagcaccaatattcgttattatccggtagatcccagtattcgtcaggcgctcacactaaaaaagaatgtcctttctcaacgaattcttgaaaatatcgtctttattgacttgttgagccaaggttaccaagtatatagcggccgtatcaaagataatgaaattacctttgtcgcaattaaaaatgatatctttacctgtattcaaattgcttattcgcttgctgatgatggtgcctatcgtcgggcgatcagcggattacggcaactttcctcaaaatatagaaagcttttaattacagtaaaaccagcgctcaattacgctggcttagatcctgatattgaaattattgacttatatagctggctaaccaattaaccccgtcgcaagtaaagcttatccacgacatggccagtagttttgtgtaaaattacgtcagcacgactcttagttggtaggataaactcccgtaaattaggaaggtcgacacgttgccaaacatattttgccattttaaatgcttcttggcggtcacccttcgaataaggatagtaatagtttgatgggtcagtaaaggctgtatctaacagcatcccaaatcgttgaagataccaatgctcaatcaagtccggatctgcgtcaacgtacaatgaccagtcaaagtaatcactgacatagagttgctggttacttggcaattgcaatgtgttgatcccttctacaattaatatatctggactatcaattaccaagggtttatccagttgaacatcataaacctgatgcgagtatgtaggtgccttaacaactggttcccctgctttgacatcattgagaaactttagaagtctttccatatcatatgattcgggaaaacctttccgatccatgatcccccgccgttttaattctgcattaggatataagaacccatccgtcgtcattaattctacccgcttatccggcaacatcttatttagtaaaatactaatcaaccgagcgatggtgctcttcccaactgcaaccgaacccgcaatcccaataatatatggaatgcgcatcgtggaacgctgtaaaaagtttgctttttgcatctgccattccaaaaaattctggtagcgcaattgaattaattttattaacggcaaatatacatcctgcacatcctcaattgaaattcggtcattcaatgatttaatttcatccaagtttccttgggttaaccgcactgaatcagttgggaaaaagccgtgccatgtttgccgatcaaattgttcgtagttcatccattcatccattatgcaaaatcctttatttcacccgttaatgaaaacggttactcacatttaataataacatattataaacataattaaagctcaatctagcttgtgaacacctaaacattttaccagataattagcgcaacgcaactgtttgaaataaaaatggagactagtactattactggcctccattttcatttgattatggtttagggaagtttaatttcggataatcctttaactcaggtgcatcggttgtataatcatcgaaggtactctggttattattttccgacttcaaacttgtcttctgtttcttttgctgcttctgtaaattcttcaagctcttcttaaggttataagtatattgttttttatcaactttcttaaatcctgggagtttgtagaaccgaagcaagtcaccattcacaactttatctgataatccaagatcagttgtaacatatttttgaatcttgccaatttctttgcgctgagccgcggtttggtgagtaatttgcttaccattcttagtgtaatagtaatcaccattatacttagtgtatttaggcgttacccaatcaccatttctaaacggtacaatttgcttattttcaggggaaagtaagtcttgtccgaattgaatataattcttagagctgattcctaacaagtcctcaagagtaggtaagacgtcaatttcgccaccataagtatgattaatcccaccttttaggccaggcatattaatcatgaatggcactttttggaacattgctagatcataattagttactttcttcttacctaagatttgcgcaatggctggttggtggttgttagagattccatagtggtcaccatagagaactaacacactgttttgccgtaaccctgtcttatcaaggtaatcaagaaattcaccaagagattcatctaagtatcgtgcggtttgaatataaggatcgaccgtatcatcaccagtcttccacgcttcgatatccttattctttttatcgaggatatatggatagtggttagtaactgtgatgagctttgcatagaatggttgtggaagctgctcgatatagtgggctgattctttcatgaagatcttatccttcatcccatatccagcatcataatccttggtcttagggtaatactctttactaaagaagtattggtaaccaaaagacttataagcattatcacggttccagaaactaggaacatccccgtggaatgatgccgtggtatagccaagtttttgatgaagaagcgctggcgcagattggaaggtattagttgtcccatcagtaaccattgctgatccttctggaagaccaaatagcgagttttcgagcattgtttcagcatccgccgtctttccttgaccaacttggtggaagaagttatcaaatgccaaagtatcattagcatggtacaacttattcaggtttggcattacttcttgaccatcttctttatagtcgatcatgaattgctggagactttcaaggtgaatgataaaaatattctttcctttagccttaccataatattcaacatttggcgcagcataattactatggatgaaatgcaaaaccggctttaattcgtcgcgattagcacgcgcttttactacactgttattagttgtcttaactccatcataaactgtatatgcttcgagccctagatacttaacaatatagttattatcaaaagttcgtgtaagtaattgtgaacgatcactttccgccattcctaagttaactccaaatagcacgaagccaagggcagtaatcgtcatcgcatatctaaccttaaagcgccgcatatcaacacggacaaaatggaaaagtaagatgagtgctaaaattacaacatctaagtaaactaaaaagtcttcgggacgtaatattcccattaaacttttaccaagattatttgaagccgctccagatccctttattacgttaaaggtaatgaaatctgaaaattctcgatagtacaaaatatttgcaaaaagccatgtcgataatgccgcattaattatcaacataatccaataggacaagcgcccacggaaatacaatgcaattcccaaaaatacaagggcacttggaatcgtattaaatgctaaaaggaattgttgcatgcttccttttacacctaaattaaattcattttgataggcccaatagctctttaaacaaaataaaagtacaacaagcagaaaaaaaccgagcttggtattcaagacacggcggagcttctgcaacgctgttttcatagtcgttcctccataaaaaaatatcattattaacaataatacactaactagctaaccgcaaccgtacaattttatttttccaaaaagttaaaaattccgtcacttttctgtcgtagttagccttttgaaaatagatcttaaatgttatgattgagtgtcgttaattaacagaagggactgagcaccatttcaaagaaaaaagcgaacttaatgttactgctagttgctattttatggggaagcagctacgtatttgccaaactaacaattcaagctggaatgcattctggagtcatcaatgcttgccggggaacaatgtgtgtaattgctggctatattatcttccataaacagatcaaccaaatgacttggctggattttaagctaggactccttatgggaacaatcaatttcctgggttattttttacagactgatgccctccgttatactacgccggctaaaaatgccttcttgacaaccttatacgttgcaattgctcccttgattttatggctattttggcatgaacgtccacagcggaagacatattttgcggtcgccctcgcgattatcgggatggccgtcatcactaacgttgctaatactgggcttcaattaaattttggtgactttctaactgttgtttctgctatcttttgggccttacaattaatcttctttggaaagtacgcgccgaaagtttccagtccctgggtggtaatcttcatgatcggcctatgtcaaggcacgttcggctggattacgaccggattatttgaacgtaccaatcttccacaaattcattgggttcaagccctgattccccttgctattttagcgatcgtcgtaaccttcttagcgcaaggaatgcaaattacagctcagcaatatactgatgctacatctgctggattattattgatgttagaatcattttttgccagcaccatgtcagttatcatgggctatgatccccttacaccacaactaatttggggtggtttaatcttacttttagccaatgcaattatgcaagttaatttccaagatgtgccatttttaagaaaacagcattaaaaataacgaggatgaaaagttttttcatcctcgttatttttatttgcttactttcttatcttccttggcaaccgctgcttgagctagcaagttgacatagttaaatggtcggtcaaagtttggctggaacattgtatcatacattccaagaaattcaattgtattttggttctgaatgcataacgaaatcagacttaaagtttctgaaatatcgtgtttactcatcatctgtgctcccaagattcgttgggtatccttatcccaaaccaatgacatcaggaccggcgtggtagttggcttgaactactcccacttagctaaacctacggtttaatgcttgaagtgggagattctggaaacatcgcatacttaccctaccgattctgaacgaaccttcaagcagaggttacgactattagccaaggctcgtcccgagcctaactttatctatcggatagctaatcctttttgcaagatgacttgtgcagcgttaatatcacgatctaaatgtttaccgcagtttggacaatcccactcacgtaccgctaaccattccgatttattcaatcctaaccgatgattattcttcccacaattagcacaaatttggctagtatatgacggattgacctgaataagctttttaccgtaccagtcacacttatattgcaacatatctactaattttgaccagctagcgttaccgattgctctagataaatggtgattcttcatcattcccttagtattaagtttttccaacacaatgatgtcgtactttttgaccaatttagtagtgaatttttgtagctgatccaaccgttggttggcaatcttttgccgatacttcgccaccataatacgagctttctgataattcttaaaatcgtctaattgccgtggaactaacactttattatgatgattccaggcgatttcctgctgggcctttaagaaccgacgactacgcaatttctcccaacgatacaactttttacggtatttgtcttcaaaatgattgatcggttccttgcatccatctgaaagattaagtaatgacttaagtcctaaatcgccaccaatatatttacttgttttaggaagagtttggttttcgctttccactaaaacagtaatgtaatattgaccagcaacgttcagacgaacagtgacattcttaattttacccattggcaatcgaccagctctaaaatagacgataccgagttttggtaactttatatgatggcaatctaaaactttaatattgccattaacgtactttgaattgtagctctgagaatattttctggatttaaatcgagggaacttattttgacctttaaaaaagcgttgaaaagcatcggctaaattgcgattagcactttgcaaagcagttgattctgcttgtttcaaccaaggatactcaaccttaagttgtttcaacagattattcatcccaaaggcattaacaaatttagcttccggattgttcttgcgccgttcaatttgcatattaagcatttgattccatacaaaacgaacacaaccgaaggtttgccagagctgatttcgttgtgctgaattcggatagatgcgcattttaacggcttttagaaccattattttctcccttgactttcaatatatcgttttaaaacttctaaaggcgctccaccagtgctaattaagcaatagctttgtgtccaaaaggctgatttccaaagatactgcttgatttctggaaattgttttttaaccattctggagctagacgatttgtaagcatttaaaaatttagccatttccgtatgaggcgttgctctaaacaaaacatgtacgtggtcctgatcatgattccattcttgcaaattaatgccgtatgcttgtcccacaactacaaaacgatgtttaagatattcagatatttcatcgttaattacttttcgacgatacttaaccaccattaccaaatggtaattaagtaagtatactgaatgctgatttctatctaattctattgttatcaccacattttatagatatatactaaatatatcatagaacaaaagaaaaagcactaacgtactttaagagagcgattcatcccctacttatagaagtgggggtattctcgcaaatttatggataaagtgcaatattactcttgccatttatttatcaacattaactttttcatattcatctgtcggcacttgattcagcaaactagttgtcctgccaattgatactaagcttaactcatgcattgctcgagaacaaattgtatataacaattgtcgctcatcgttaccatggtattgctgatcattcgcattccagacaataaccgcatcaaattccaacccttttgctagatatgacggcacaacaattggcccctttactaaccgttgattctctgtccgaataacggtggtcttgatattattggcatttaacttttgatacaactcttcactgtctttgagatctttaccaataattgcgacggcatcatggtcattctgatacttattaagaatattaataactgccgctaccccttcttgttcatccttagtttgataaacttgtggcttattaccttcacgttcaaaggcctcaattgcttcaccgtcaattaaaatatgcttagtaaagtcggtaatttgtttcgtggaacggtaagacttagttaattggacaaccttcgtcttttctggatcaaacatcgtccctaactgctttaatagtgaccgactattctcatgagtgaaaatcgcctggttaaggtctcctaacaatgtgaatttagcacggggaaaacgatatttaaagtaagctaactggtaagcatcataatcttgaacttcatcaacaaaaacgtaacgaatatcacgttgaccacgctttccagtaatcaaatcatacaggtacaggtaaatggtaattccgtttgcactgatatttcccttctttagctcttcttttatcccatcaacataacctttccattgctctgcagaaataccgtattcagcaatattaacaagttttggagttacccggagaaggtgtaaaaattgtccattgatgttaagccactgattatgatcgatggctttttttattggcataaatgcccgcataacgatttgacgcgcaaggaacttgtattctttatcttcatcctcaaattcacgtggctggttattaaataggttgtcgatttcttctttactcaagctttgaatttcatcctctacccatttgttgcgcatttcagatccaacacggtgattaaggtatttaataagagcttctttcgttccatccaacctatttcccaggttatagttattgttaaatgagtagtaaatctccttaatcttatctttgctcaaaaagactttaccattaaacataaggttgcggaaacgcatattagcatgaccaagatggttagcataacgctctgttgctttgaaatattgtaagctagttaatagttgttgtgcattcttagccgtttcatcttggtgactttcaaaccgttgttctaagttttgaacatgaagctttggtacccgacgattagcaaactggaagtaagtcatctggaccatattatgctcacccaattccggtaaaacttgatcaatgtagtcattaaataattggttaggtgaaaaaagaacaacttgtgaagaggtcaaattaccccggtaacggtaaagaagccaggcaacccgttggagaactgcagctgtctttcccgagccagcagccccctgaacaaacaacaattcatttttagtgtcacgaataatttcattttgtttccgttgaatcgtcgttacaatgctcttcatcttggtacttgaatggttaccaagagcatcaagaagcatctggtcgcctacttgttcgtcggtatcaaagatggttacaatcacgccatctttaatttggaattggcgcttaagagtaagatcaacctcttgttcacctaccggagtctggtacttaactttcccgagctttccttcatagtaaacagacgaaatcggtgctcgccagtcataaacaagaaagtgatctggcttatcggtaaaagatgcaagcccgatatataccttttcggattcattggcacctttttcacgaaaatcaatgcgagcaaagtaaggtttcttttcaagtcgctgtaaagttgctagccggtctgcagcgtgttgccagctattttgacgttcatctagcatctgctgttgagcacgaaaagacatggccgtatccatcatgcctgaataagtagtggtatttaagtggatatcatcaatttgcttattgatgcccttaatatcatgttgagccgttttaatcttttcttctgctttttgttcggcctgttttactttatcaatcacattatcaaggtacttttgttctagttctttttcagttttcgtagacattccatactccctacctttcatcttcaggtcgacttacttaataatttatcttaaaatgatccaattattatatcattttcgccaattagtctgttaactttccgccttctattttttcaattattaaatgtcgtttaattttaatcctaagatcatcaaaataactaataataacgctacaatatattgaaaccatgatccaggaggaggaaaacaacaatgagccatattttttatcttctaactcatattgcggaaataattattcccatgtttgagtggatgggcgcttggagctatgttctcctttttatcctaatttttatggaaactggattagtgattttcccatggtttcctggtgaatcactcgtctttttaacttgttctttcattgcttttaacccgatcttaaaaatggaaatcgtcatccccgttttctttttcgcggcgctaattggtgacacagttaattattatattggtcattccctttctcattggcaatggctcaaaaaaagaatggccggtccccgctttgagaaagcacaagaatttttagcccgtcatgggatcaaagctgtagcattagggcgatttgtaccgctcattcgtacctttgtccccttaattgctggaacaatgcagtttccatttcaccgtttcacaattggtaatattattggcgttacattatgggtagcgattggtgctggatgtggatattactttggaacaattccgtttgtccgtcagcacttctcacttatcatcttagcatttgttgtgtgttcactgttaggagttggcttgttagcacttatcaaagcgattcgtcaacgaattattaagcgaagccgaatgctataattgctttttcttcagcgaaatcatgttaaaatgtaataagtatttttatttcgcttaaaggagtgctgtaactatggcaatcaatgtttattttgtacgccacggacaaacctatcttaatctctacaatcggatgcaaggttgggctgatggcccgctaacgccaaagggtgaagaagacgctaaacgagtaggacgggcgcttgctcctattcaatttgattatgtattttgcagcgacctcgcacgaacagtttcaactacccgtttcttgcttgctgaacatcctggtaataatccaacgccaattccagagccagcgtttcgggaagaattctttggctactttgaaggagaagatggccaacattttgctgactttcttggcggcccagatggttatcatagttttgcagaaatggttgccgggtggggtccagacaaattaaaagataagattgcagccgcggataattatggtactgctgaagaccatgttgctttctggaagcgggttgacaaaggttttgaccgcctacgagcattaccagatgggtcagaagtgctagtagtttcacacggagccactattcgctcaatcgtccaacgctattctgacgcttacgatccaggcgattcaccacgtaacggcagcatcactaagctaactttagataagaataatactactgttgatttttataacaaacttgaattaccagaataatatccataaaggaggaacattattcttcaatggagactaacatacaaactctagaaccagtaattattactggattaaatactgggcaagaagactttgactactcaatggttgaacttgctgaattagcacaagcaaatcacatggaagttatcgatcggattgatcaagtcatcgatcgccctaatcccgctacctactttggaaagggcaaagtagaagaaattcgcgatgtggctgatgctaatcacgttcctactattattaccaatgatgaattatcaccaagtcaactacgtaatcttgaagaaggaaccggatgtcgtattctagaccgaactgctcttattttagagattttcgcaactcgtgctcaatctaaagaagcgaaacttcaggtgcaaatcgctgaacttcaatatcgcttaccacgattgcaaactagtgcaagtgagcgcctagaccagcaaactggtggaggaagtggctttactaaccggggggctggggaaactaaacttgaaatggatcgtcgaactatccaacatcaaatttcccaccttcgtcaagaattagcagccattgataaatctgaacagacaaagcgaaagcaacgagcaaaaagcgccattccaacagcggccctcgttggctataccaatgctggtaaatcaactattatgaatggccttgtaagaagatatggagctgctgaagaaaaaaccgtttttgaaaagaatatgttattcgcgacccttgatacaagtgtccgacaactaacgcttccagatcaaaaacgtttcttattaagtgatacggttggattcgttagcaagttgcctactcaccttgttgaatcatttaaatccacgcttgcagaagccgctaacgccgacttattaatccaggttattgattattctgatccgcattacaaggaaatgatggaaacaactaacgagactttaaaacagattggaattaatgatattccaatgatcaatgtgtttaataaagcagataaaactgaaatagaatttcctatcctcgaaggtgacgatcaagttgttatctcagcaaagcaggatgcttcattagatcttctcgttgacgttattaagaagcgtctctttaaagactatgttactaccacgcttttaattccatttactgatgggcacgtcgtttcttacctcaatgaacacactaatattttagatactacttatgaaagtgatggaacattattaacggtagaaatgtcagttcaagattatcatcggtttggaaagtatgaaaagaactaacataaaaagcagcgatcaatttttggccgctgctttttatgttagtctatctctctgcttttactccgaaaatcaaggagacaatcatcactaagattactgctccaataatagatggaataattgccattcctgctacttgtggtccccatgcacctaacactgcttcaccgattgacgagccaaccagtccagctacgatattactgataactcccatcgatccaccgcgacgggttaatgcaccagcagcaagaccgatcaatccaccaacaattaaaacccaaatccaatgcataattatccctcctttttatcttccaatgtatctttaagatcagttactttatccttagcttttcctttagctttctgcaactttccctcagtttcgcggggcttgtcgttggttattttaccttcaacctcttttaatttacccactactttatctttaattccatgtttatcgctagccaatatcatcagtcctttcatctattcttggctactagtggctgacaacattttattaatttcgctcccttccataatgactagtgctttcaacagttttaagtttaacagtctcccaacaagaaagcgatatcttaatagattacttacgttttctttaataattttatttatgtcttaattaaaaagaaactctaccttcataaattggtagagtttctttttattcttgaacttaattacattcttatttcatttcgtgaatgcttgccttctaaaatcgtaacagcatcattcaaactaatctcgaccatattacgaatagatgtttcggttaggaacgcaacgtggggtgtaacaagaacatttggcattgccgctaatttcttgtaatcatctggaatttgatctgatgtaacttgcttcccaaagaaagaagtttcgtcagctaatgtatctaggccagcacccgcaatttctttattttccaatgctgaaattaagtccgcggtatttaccagttttccacgagccatgttaatcaagtaagcattgtctttcatcatcttaaattgtggtgctgcaatcatgttttcggtacttggtaacaacggtgtatgcaatgacaaaatatccgcattcttaataacagtatcgaaatcggtatattcaacgtatggttcatattcgacattgtacgatggatcatatgcaagaacttttgcgcctaatgctttataaatctgagcagtggccccaccaatattaccaaggccaacaattcccacggttaaattgtaaatttcattactgatcaagtcatcgctccaccgaaaatcaccatggctcattcgttgttcgaattcaccaatccgtcgtaacaagtacatcgcctgagtaacgcccatttctgcgattgcccttggtgaataaatagggacattcgttacaatgatgccatttgctttacatgcatctaaatcaaaaatatcaacaccaaccatccgagcagctaattgctttattcccatagctgctaattgctcatacagttgttcatccccaagttttgttgtttgctgtaaggaaattccatcatatccctctgcaagcttaactgtatcagcatttaatggttcagtaaccatcttgacgtcattgcctgtcttcttttcccatgcttcaatataaggcttttcagcgtcacgaacgctatacataattaatttcatcagttttcccattcctttcataaaaaccgcttacattaatagtttaacactcctttacttaatcatcagtattttagcaacaaaaaaagcaaagcggatttgaagttccactttgcttcagttatttttaattattgttcgccattatctccttggtttgggcgacgttgttgaaggtgcataccgtcataatcgccttctggtccaagcagttcttggttattatccaattccgagcgaccagcatagtgatgatgttgtaaccaaatcataccgactagtaacaatgcatagaagacaattgcgattacgataagaacagtgttacagaacatcgtgtaatgtgctcccaaaccaccagaaattgaatcacggagtcctaagattgagtaagtcattggtaagtaccagtgaattacgttatagaacttcattgtaatttccattgggaaggtaccaccagatccacctaattgaagcatcaagagaaccatggcaaagaatcgaccggggttatcaaagagcattgaaaggaacataacaattgccattgaggctaacccgaagcatatcgtcgtcacaaagaatgagactgggtgaataactgtaagtccacacgccatcataattgcgtcttcagcgattgccattgcagttactaccagtgatccaactgttaccttacttgcccaccaagcgattggagctttaccaaattcagcaacccggcgaattgggtaaacaaagttaaatacaagtgccccaacatatattgctaatgatagaacatatggtgctaaggcgtgaccatagtttggtacataactgtaatctgtgtgcttaagagcagttggttctgcaaacatcttggcagtccgtggtgaagtcttaataccattgatttgctttgcaccacctgcaagagatgtagccaattgagaagcaccagcattcaaccgcgcaattcctgaaataagagcaggagaattatcttgaagttgttgagttccggcagctaattgatttacaccagcaacaagagcaggaacttgaccgtttagttgaccaagcgcaccagctaattgagctgcaccagagttcaaggccccgctattagcgttaagctgggcaattccgttacctaattgaccaacacctgctgtatattgaccgattccactagccaattgaccagctccggctccagcttgcgcgaccccagctgtgtattgaccgattccgctagctaattgattggcaccggctccagcttgagcaacacctgctgtgtattgaccaattcctgaattaagcgtaccagcaccggcagcagcactatcaacaccattagtatattgatttacaccactattaagcgtgcttgctccagaagaaatctgacttgttgcttgtttaagttgatcaacagctcctggcattgccgctaaggtgcctttatagccatttaaggttgctaataatgcgttagcttgacgaatagtcccatccgcattatctaacacagcagacatttgtgaaagctgacctaattgttgttgcataccactcaagcttccttgaaggttactcaattgaccaagggttccacttaatccttgaatagcagcaacattagcatcggctttttgcacaatttgttgagcagcctgcttggattgttcactagctttatcatcgctaagaatttgttgtgccaatccagcaatttgaccatcgttagttgcaacacctttaagctgatcaccagcactggcagcaccagataatgctcctgaagcttgttgaagactagcagcactactttgaacaccagcaagagcattcttagcagttgtcaaaccggtctggagttgacctaacccttgctgaagattttgtgcttgatccatggcccccataatcccattaaagttaatgtttcctaactgactgttaacggttgaattcaactgattagcaccagatgctaattgacctgaaccgttccttaagttctctgaattaccacttaacgtattcaaaccactacttaattggttagcaccagaatttaaggtaccagagttagccattaaagtatttaatccagcattcaactgactagcaccagaatttaacgcaccagagttagccatcaaagtgcttaatccactgctcaactggttagcaccggaatttagtgcaccggaattagccattaattggccaacaccattgccgaggagactaaccccaccagtatattgcataataccatttgctaaggtttggctcccggtagcaagttgttgcgcaccagaagctaatggtgcaacgctaacacgcaaggtttgaaccccgttatttacttgggaaactcctgcaacataacgatttacaccatcactcaaggtcaccattccggtaccaatttgttgggcaccatcagcggccttgttcatccccttacctacaacatgtaattgcttaaacattaccgttgcgtaagcgttagtaacctgggcacgaattttttcatttagccgtgtcatccctgtttgggcaattacctgtccaatgtagttcaaggaaccattagtttgataatgtaacttcatcgtcttaggatgcttttgcaaaacagtcgttgcattttcagagaaatctttaggaatcgtaaccaccgcatagtacttgcgatgactcataccatattttgcttctttagcggatacgaattcccattttaattggtgatttttcttcaattcattaacggtctgtttcccaacatccattttctggccttggtattcaaccggaatatccttatttaccaccgcaactggtaagttacgtgtacttccatacgggtcccatactgattttaagaagaaaatactatataggaaaggtattaagcaaataaccgttactgataaaagcagtaaacggttatgaataatatgacgaaattcgcctttaatcatgctccacatttaatacttcacctcaaaatttatcctttcataattttagtttgttagtgatttggtagctgctcttgcaaacttaataacgtcctcagttggtacgtcataattattgccttgccaccagtaaaaggtcccgataatagccccactcaatacataagcaagcatctcaggattatcagacttttgcagcgccgttacaatcggatcattagtctcaagattacgccgctctaaaagaacctgacttaaaatatttaaaatttcggtatacaaagagcttcgtgcactattaggtgctaaatgacggataacatccttatttttatcaatgtatgataataattgcttaataatgtcatcttcagaatctgtattctccgtcaatttgttaatttgtgcatttaacgtttgttctaagagatcgtacttatcactaaaatagcgataaaaactgctccggtgcatcaatgcttctttacaaatttgatcaaccgtcaaactttcaaaagaatttttctctaataacgttatcaatgcattttcaaagtcacgaatagttctcgtaacacgcataactcttccctccccaaataatacaaatttaacatgattattctaacttgttgcaattcagcacaacaggggtaattaaagataatcatttcaaaataagacaaagatagctatttgttcataaatagacttttgtttgtcccttaatcaaacgaaaactataatatgctcctaaatttaactggtcaagcgtgtcatcaataactttatgggtctttcataaataaaataattattaacttgctaaatctcttctctaaaatacggtataataaaagtatcaaagctatgtgattggaggcttcataatggcaaaaactaaaaaacatttaactaaatccaaagataaagtatttcttggtgtctttgggggtatcgctgattacttcggtcttgatgaaaccctcgtgcggataatcggaattctcattttcgtctttaccggttttttcccgctaggagtcttctacctcttagctgccctcgtaatgcctgaatataatggtaataagacaaacaatgatgacaatatcgtcgacggtgaattcagagaaaaataatgttgattgcagcaaaaaagctgaggttgggagaaattccaatctcagcttcttttaagcattatttcgttgtttataagctacttgaacttgtagtccataatcttcttccgttaaaattgttgagccgcttcgccctgcaatcttattcgggcccccagtaacaactactgctgcaagatacaattgatacttatcatgagcagtatggacatcggttaggccgattttggtaatatgaccaaccgggcgtcgttccatttgattcatcccgatataaatttcaagacggtgtcgcaactcatcatgaaccaattcaaagtatggcggaacagattgtgaattcaaagccgtaactggtttttcagttgcctgatattgttcaacgatttctttttcactcaggccatcatagccgttaacaaacacaccctccattaatagttggtcaacaacacgttgtaaattatgctgttcatgttcgtcaattgctactgctgctgggatcgtgtcggcattagcaaacaagccatttgaccggtttgccaattctgccgctagtcgttgttgtgcatcaagaggggtcttagctttgccgtcctcaaatttttgaccagtaatctttgcgacacgcggtgaaataaaatcaaatcgtgaagtcttctcaagaaagtaaaagacgaaattaagatagataaaatatgttaatccaatcactgctaagccatataacaatgcccgtagccaaacatgattcataaagagtcggaacgtaacataaactaaataaatatcgcctagtgaagcaataatgatataaatacgactctttaactttacatcaaggttaaagtaactcaatgacgagttaatcatatcaagaaaactaaacattaataacccgcctccttatcattcagtcgtagttgttccggtagtattaccaccagtcgtgtcctgtgtcgttgtattattgttagttgttgtaccagttgattgtgaggtactgtttcgattagcactcgtactttcatttgtatttgctgatcgatttgtcgatgtttctgtgccagtgtttcctgctgaccgtgtagtttgattagtatccccagtatcattcgctgtattgttgctattacttgtccgggtagttgatgagctacttgcactttcatcatcatcattatcacgatcgctttgtgaattccgacttgattgattgctttcgtcatcacctgattgctgaaattggcgacttgttgatactgatgttacttttgcaccttcagaagtatgcgttgccttgttaaccactacattggtggcacccaacgcaagtaccaatgatacaagtgcaaagggggttactaatggcggtatctttgctcccatgtctcattctccttttccagagtatataatacacgaaaactggcccaataaatatgaatttattgtaaagattttttctggcattgggcacatattccgtgcaattcaaaacgatgcccagtgattttaactcctggcaactgcttttcaaagaatttcttatcaattggtggcatttgaatctcttgaactcgtccgcaaatatcacaaataaaatgatggtgatgcgtaaaatcacatgaatatttaacctgcatctgatcatgatgttgacgcaattcgacaatacccagtttctcaaattctttgaaatttcgataaatagtatcgtgacttaatccagggaattgttctcgaagatattggtcaatttctacaatattaaagtaacgatcagggtgtcgcgcaactgattcaatcatcattttacgttgcttagtccaccgcaaatgatgatctttaataatggtctgtgcttgatcaattaatttctccaatattttccctcccgattagagatgatattgtaacatattttagttctttttggataatatctgcctaacaattacatctatttgttgtttggtatttttccactggtcgttaactacgacatgcgcgatcccttttaaagccgctggcagggcaagatcacggtggtactctttgctatgcaagcgagaatgaattgcactcaatttatcgccccgcagtgtcattcgcttagctaaagaagccatatgggtaacggtcaagaaaataattactgcttgggcaccaagttgttgatggtaagtaatcgcgccagctgtgtcaagaacaatcacgtcattttttccttgttcccatccttctgctaagccttctaatgaagaaccgtattgaaattggtcataagtgacttgctcaagcaaatggagtttcttcagggaagatggtgtttcaaaatgatagtctaccccatcttgttctcccggacgtggcagccgggtcgtatgggtaattacccggtgcatatcataatgatcttgtaggtagttagcgaccgttgttttgccggaccccgctgcccctgtcacaataaacacatacttattatttttcataattgtttattttaaatgatcgttaacttgatctaacagttcttttaaattctcgtaggttaaccgttcacgagcatcttgataattgaaccatccacaattcttaatctcttctgcttgcagatgaatgtcttctttgttatttaactcggcagtataaagggtcatttgcttatgattgccatttggtaagtcgtattcggtatacaccttaaaacttgtatcaattggtaattctaattgcgtttcttcttttatttcacgaattgctgtttcttctagtgattcatcgccttcaacgtgacctttggggaagccccagaagtgtcccttattttgactttctaagagtaaatactcgatcccgttttcgccttgacgatatacaactgctccactagtaacttctattgccatttttatccctcttttgtaattaaatttctctaatttacttttaatattaactaaggtatcattattaattataaacgtgacgaaccatttcggcacgtacaatttattatagcaaaggtgggttaaagatgagcttaaacattatgcgaaaagaaagtctcgatcggtatcttggtgaagacaagcttttcgttaaatcaatgaatgctcgtgatctcatggcaattgggatcggtactgttattggtactgggattttcattctccctggaacaattgccgcaaattcagctggaccaggagtgtcattgtcatttctgttttcagcgattgtctgtgcgctagctgcaatgtgttatgctgagtttgcttctgcattaccagttgctgggagtgcatactcgtacggaaatgtagtgttttgtgaattccttggctggttgcttggatgggcattagttcttgaatacatgttagctgttgcatctgtttctacaggttgggcagcctacttcaatacattacttgaaggatttggtattcatcttcctaaagcactctcaggtccatttgatccagcccatggtacctacataaatatcgtggcggttgtaattgttcttttaattacagtaatgcttgcacgggggatgcaatcttcactgcgtatcaacaacattgctgttttccttaagattgcaattatcttgatctttattattgttggtttcttcttcatcaagcccaaaaattaccatccattccttccataccacatgaagggtgttattcacggggcaacgattggtttctttgcttatcttgggttcgactgtgtttctagttcagccgccgaagttaagaatcctaaacggaatatgccgctgggaattattgggacacttgctgttgcaaccatcttatatactggtgttgccgtagtcctaactgggatggttaagtacaccaaacttgatgttgctaatccagtggcattcgccttacagatggttcatcaagactggttggcagaattattatcaattggggctttgatcggaatgttcacaatgatggtttcgatgatctattctagttctcgtttgatctatgcaattggtcgtgacggtctgcttccttcattcttaggcaagcttgatgaaaaaagtcactcgccacaaattgcattatggatcgtggcgattattatcgctatcatgggcggacttgtttctcttgatcaacttacaagtttagttaacatcggaaccttgtttgctttcatgctcgtttcatttggaattattccgcttcgtaagcgaaaggatatcggtaatcgtgggggctttaaggttcccctctaccctgttcttccaattctttctggtcttgcctgccttggcatgatgacccagttgcaaaaagaaacgtacattggcgcagcgatttggtttggaattggaattgtcatctacttcacttacggctactggcacagtaagttagcagataagaattaatagcaaaaagttaagcagagagtgagattgattttttcttactctcttttttatttgaaacagcaatttgcattaaataccatttttttgttaaggtagtattacttactttttttattcacaaggaggaatcaattagttaggccaaattttgatcacatatgcctaattttttatggaatatacaaagaagaattacaaaaaagcacctttatcatcaattcactttcgaatatattttgccctcgctcttggacaaattgcttgtggttttgctcttggaattagtggaaccgcactttcccaagcaactgattatatcaatatccccgacttttgggttggcctaattggtgctgggagtttaattggacttgctgggagtgctttaatgggtaaaatcgctgaccaatttggccgacgaagaatgttgatgctcgatatgtatcttttttctatattttctcttttgcaattagcaacaatgaatcttgttatcctgtttatcttacggattttaatcggtttaatgattgctattgactatactgttgggaatgctctattggtagaatggttaccagtaaaagaaagcggccgcctacagagccaactaatcgtttactggacaattggctttattacttcatacattgcaggaattttaataacagggtttggcactcataattggcaagttatccttgcatcaagtgtcgttccaggactgatggctgcaatctatcggtcaatcttccggattccggcatccccgagctggttagcaagtcaaggtaagaataaaactgctcaaaaactaattcaaaaacaccttgggaaaaaatggggattatcattaaaacaaattcgtagtaaaaaaccaaaagctgtctctcttaaaaccctctttaatcccccttatcgccgaaaaaccattgttggtggcttattctatgcttgtcaggcattttcatttttcggtatcagtatcttcttaccaattctcctaaaaagtatggatcttggtaataacaacctctctgggattatctataatagttgcgtccttatcggcgtaattttcggtagtttaatcttcaagattcttagcaggcggatgtttttggtaagaacatttttcctttcagcagcagcccttatcttattaataattggcaataacttttcatctttcttccaaattagcgtttttgcgatctttgcgatagtcttatcttcaggacttgtccttgattatccatatccaacagaactatttgatgttaaggttcgagccagtggagttggtacttgtatcactatcagtcgttttggggctgctagtggaacattcttattaccaatcttaactcatcttggcggtcccattttagcaatgctagtttgtactcttgttttacttataggtggtactatctgtcttttatgggcacctgaaacttcaccaaaatatatttaacattaataatagaatggccgggaaaattttaaatttttcaccgaccatttttagttttaaacatcaatccaatagactaatcaatttttaacaaataaatacttacgatcatgataaatcacaaaaataccagtaataacaaataaagtaatcatgctgactcgcaagtaaaacatctcgcgactatattgcagctcctgttggtgatcgatatacgggataaggagcgcactcttattatcaagttgaaaatatgaaattaattccaaagcaccaaataaaataatttgattacaaagcgaaccaaatacggatagtttttgatcaatactgctatatttatcgggaacttgttttcgtgcccactttcctaataagatggcacaaaagactgttatagctgttccaagcaaatataggtaatcggtatacgttaagaataagccaagagtaagacagataagggcggttttatagcgagtagttaatggaagcttttgcaatttaggactcaatgcgcccactaacattcccgaaagcatcaattcgataaagacaatgaaaatccaataagctttattctgttgaaaagcaaatagtaaagtatagataatgacataattcttgatcgctccgagccaaatacgaaatagtttaaaaggttgtcccagaatatttcgtagttcaagaataatcccaataattgctagcacgattagggcccaactaaaatcagaaattcgccccgtcttcttaaagaaactaataataaaaacaacggtaagcacggcgatggcaggaaaagccgtttttaaattaaaagagaattttaaatccaatggtgtcttatctcgtttaacaacaacgtaagcgtaaataacttcaaggcccaggaaaaaagtataaaaaacaaaaccgacaactaacggcagcttcatcagtaaaatcccgagagcgatcagtccgataattacactaaagcccgcgataacatttactcgcttcaaatcaatctcggaaatttccttattgggatcgcccagcaattttaaccccgtcacgccaaaaccgatcaagatcgccgccaagctagcaagccactcaaatcgaaaataaatcccaatagaagcaaggactcccccaataaaagcaataactgaacaaaacttagtaacaccagaccaagaagctaaatttaggcgtccatcgagaataaagggcattactttttcaacggtgtaaacaaaaatgaacggccaaacaaatgtgattatatttgcatgagcaatgatagagaatgcaaatagcaacgttggaaatagaatatagcttcgagcaacaaattcatggttaattgctaaaattttcttcataagcagcctccgatcattttgccttttatttttagtaaaccacatccccttataaaagaaaaagaataggactcctaacatgatttttaatgccaagagtccgattcttttttataactatttagcaaacatcttaaattctaaaaacaaatcattatattcgcctaaaacgcgtaatggcaaatcacgatatacttgcaaatgcttcatcgttgtttcaggaggatagaaagctttgtcatcggtaattttcttgggtaattcttttttagccgctttatttggtgtcgcgtatccaacgtattgagcattttgagccgcgttttggggatctaacataaagttaataaattcgtaagccgcctttttattacgtgctgctttagggatcaccatgttatcaaaccatatattgctcccttcgcttggcacaacatagtgaaggtgcggattaatattcatcatttcgcgcgcgtcaccagaataggtcacacccacggctgcttcattttgctccatgtacatcttcatctcatcagcaataatcgcttttacattgggcgtcaactgctttaaatgggcctgcgcaagcttcaactgctggtagttggtcgtattaacagaatgatgctgagtaataagggcaaccgcaaacacatcccgtgcactatcaatcaacatgacattattctttaaacgcggattccaaagttgttcccaatgttggacgtctttgccatttactttttgatcattatagataatacctaacgttccccaaaagtatggcacagaataacgattgtcggggtcaaaagaacgatttaagaattgcggatcaatatacttaaggttaggtaatttccgatggttaagaggtgcaattaaatgctcctttttcatccgttgaacagtgtattcacttggcacaacgacatcataattagtcccaccttgccgaatcttggttaacattgattcgttgctatcaaaggtttcataatcaacatgatagccagtttgatgttcaaatttcgttatcaatgctgggtcaatatagtctccccaattgtaaatggtcagtgtttgtttaccaccaccagttttttgctggttaaaagcaacgtccccaagcgctagcaagatacaaataacgacaatcgcgaggaacgcagtaaatatctttttcattgtgcatccccctctttaacagccacaatccgtgtccgtcgaccgccccgtttactaataaggtaatagccaattactaacagaagtgaaacaataaacatcaacgtagagagggcattgatttcaagattgattccttgccgcgcccgcgaatatatttccaccgataacgttgagaagccatttccagtaacaaagaaggtcacagcaaagtcatcaagtgaataagtaaaagccataaaatagcccgcaaaaatacccggggcaattgatggaaggattacccgggaaagaacttgccagcgactggcccctaaatcataggcagcatctactaatgttggagacatttcatttaattttggcaaaaccattaaaacaacaatcgggatacaaaaggcaatatggcttaagaggactgagacaaagcctagtcttacccccagcatggtgaaaaagattaaaaagcttgccccaataattacatcgggcgagaccattaaaacattatttaaggataataaactattcttccacgggcgccgtgcatccttaattgccaaggctcctaatgttccgataatcgttgctaatagtgacgccaaaaatgctactaacaaggtattgataacaatggtaatcattcgcgtatccgcaagcaaatccgcatagtgttgccaagaaaagccatggtatttttccattgtttgtccgctgctaaaggaaaaaacaactagatacaaaattggcgcatataagatcacaaaaactaatgccaggtatgcttttccccatgaccatcgctgctttttcattaatggcgtcctcctttctgtttcttatcaccagtcataaacataataataaacattgcgataatcagcaccaccccaatcgttgaacccattccccaattttgcgttgtgaggaaatgttcttcaatcgcagtccctaaagtaattacacgatttccaccaatcaagcgggtaatcataaagagtgaaagcgatggaataaaaactgcctgaattccagcttttactcccggcatagaaagcggccaaatcacccgacgaaaggtttgccaatgagtagcgcccaagtcatagctagcatttattagtgacgggttaatttcagccaggttattgaaaatcggcaacaccataaacggaatttcaatataagcagccacaaacataaaactggcatccgtgaacaaaagctgatgactcccaaggcccataaactggaggaaaccgttaattgtcccggttcgactaaacaagccaataaacgcatacgtcttcaataataagttgatccatgttggcaaaattaccagcaatagccaaaactgcttgttaggcaatctattcaaaacataagcagtgggataactaatcactaatgtcacaagggtaatcaaaaaggcataccaaacagaattaagcgtcatcttaagataaacacctgatgtcagatattcagcatagttattaagggtcagctggccattgatattaaaaaatgattgataaagtatcaataccaatggagcaatcacaaataggataatccacaatgcatatgggacgataaacatcgctttttgccgcattagtccccctcctcatagctatcaaggcgagcatcaaaatcttcttcactttcgttataccgcataacgtgaatatcttcgggatcaaatgtaatccctactttagccccgacctttgttttatgaatagaattgattttccacttatggttacgttggtcaatcaccgtaatttgataatcaacgccacggaaaagctgggtttcaacggtgccgactaattttcctttttcaaccgtcgtaatgtcaagatcttctggccggatgacaacttcaaccttttcgtttggtttcatccccgcgtcaacacaatcaaagtcttgaccattgattgaaactacatagtcttttttcataatgcctggaacaatattgctttcgccgataaaatcagccacaaaatggttaagtggttcatcataaatatcaacgggggtcccactctgctgaatcttaccatcattaataatcataatctggtcactcatggctaatgcttcttcttggtcatgggtaacaaagataaaagtaatccctagccgccgttgtaattgccgcaattcggtctgcatttgaactcgtaacttatggtccaacgcagataaggcttcatccaacaatagtactttcggcttattaactattgcccgggcaatagcaactcgctgtctttgtccaccagacattgcggtaatttcccgatcaccatagccatctaattgaaccaggtgcaaagcttcttttacgcgttgtttaatttccgcttttttgacacccttaatctgtaatccaaaggcaacgttttctgccacattcatatgagggaaaagggcgtaatcttgaaagacggtattgacttgccgttgattggcgggaatatcattgatttgctttccatcaaaataaattttcccgctactaggatgatcaaaaccagcaattaagcgcaaaattgttgtctttcctgatcccgatggtcctaataaggtatagaatttaccggcctcaatttcaaagcttatatcacgcaacacaacgttatcatcatactgtttacttacatgctgaaattccattatgttttttaccatcagcgtttccccaatcatcattttttaaactaagtcttagtataaagtatacgccttaaatcgcaacactgtttatcctaagcaaattattataaaagtgcgataattaatatatcaaattttatacgaggtgttccagatgaaaatcaatcaatttagtattacttcaactacaccacaagcacggcgccaagaattaatgcagattcacttgcttcggaaaaacgaagaacaaactttgacaccgaacgcaatgtttgaaactttcttagcacgcattcatatggcaagtgcccagccgatcgtcactaaacagtggcttcatgacctcttagctacccctgaccttgctcttgatgattggtttgaccaaaatcaaatattaaccgatgaagtattttacctcgtcgctctccaactactcgattttgaggccgcagttgattttgacattacagcttcccttgctacagttaagaaaattggcttgccagtcgaatcacatcaaaaatggacaaccgcaaacgttatcgatgctttttaccttcttttaaatactcataacaaaaatggtcaatcgcttattgatcatttaacggcagagggctttatggcttggagttaccaacttccagctgaacaaaaaccgttctttttcaatgggaagccgcttgctagttttgatcctgctaaattcattcgtgaggttgtttacattgagaccgatatggataccgattttgatggtaaagcagatttagttaaagcagaaattatgcggccaattgagtcagaccatggcttaaaagttcccgttgtctttactgctagtccttataatcaaggaacaaacgacgaatggggcgaaaaagcaacgcataacgtcaatcttcctttgaagcataaggatcctgattatcaggccccgactgaagaaaaatttccgactgacttttcacgccaaaaagttactggcgaaagccggcaagctactgagacgtttagtaccacgccagcatacacgctaaataattacctcgctgcccgtggttatgcggttgtttattcagccggaattggtaccaaagattcggacggtctgcaaacgtgtggttctccagaacagactgatgcgatgaaggctgtcgtcgagtggcttcatggtgatcggcaagcctttactgaccgtcatagcggtaccacaatcaaggcgacctggtgtaatggtaaagtcgcaatgacaggacgctcatatctcggcactttagccaccgctgtcgcaaccactggtgtaccaggcctcgaagcaattattagtgaagcggccatttccagctggtatgactattatcgggaaaatggccttgtccgcgcaccgggtggctttcaaggggaagacgcagacgttttagccgatgaaacattcagtcgaaccaaacgtcccgcagactaccgccgaattgaaaaagtaaatgataaatatattgctaaaatgcaaggagcaatggatcgaacaactggtaattataatgaattctgggaccaccgcaattaccggcatgatctcgaaaacatcaaagctgctgtgatgatggtgcatggccttaatgataccaacgtccgtcctagcaatgttaaggcactttatgacggtattcaaagtctgccaattacaagcaaactcatccttcaccaaggacaacatatttatatcaatgcctttcgttcattagatttctctgacatggttaatctctggcttgctaataagctctggggacaagaaaatcaggctgatgatacgttgccaagcgttcttgtgcaagacaatagcacccccgaaacttggatcgcatatgatcaatggacggcgggcgaacagaaacagtaccaatttaacgaccatcgtctaacgaatttgcccggactaggaatccaaagctttaatgaccaacaaccagaagaaaagtaccttcaatggtgtaaacaaccccaagcatgggcaaaggcactcgtgaaggataacggtcaatttagtcggcgctttgtaactgctgtatttaatgatgatacgcttctccgcggaacaccgactgtcaccttaaaagtagcttcttcgaaaaattatggaatgattagtgcccggcttgttgaccttggcagcagcaaacgccttacaatgtcgcctgttctgtttaatcgtaatggtcttgagctaggttatcactggaagacagatgatcttcgtgaatttaaattagcaaaagaagcaactaattataaggtaatcgcaagtgggcatatcaatttgcaaaatcgaaacaatccagcacaagttgatgaattagccgctaatcaatttgtcactgttaagtttgatcttcaaccaattttccaccgaattgtagctggtcatcaattagggatcattatttatagcactgattacgaatacacgcttcgtggcaacgaacggattgaatatcaattagcgctgaatggctgtcatcttagtattccaggtgttactattttgaactaaatgctcactaaaaagacaacgcattaaaactagttttagcagaattcagctaattgcggtaaaatagttagtattactaataaaaaggagagattcgagaatgaaacaaggcactaaaattattacccttgataacggctatcatctatggacgaatacccaaggtgaaggtgatattcatttattggctttgcatgggggtcctggtggcaatcatgaatactgggaagacgctgctgaacaattaaagaagcaaggtcttaacgttcaggtaacaatgtatgatcaattaggttcactctattctgatcaacctgatttttctgatcctgagattgctaagaagtaccttacttacgaatatttccttgatgaagtagatgaagtacgagaaaaacttggcttagacaatttctatcttatcggtcaaagttggggtggccttttagttcaagaatacgctgttaagtatgggcaacatcttaaaggcgcaattatttcttcaatggttgacgaaattgatgaatatgtcgaccgagttaatgaattacgggaaaagactctttctccagaagcggttgcctttatgaaagaatgcgaagccaagaatgattacagtaatcctaagtatcaagaatacgttcaagtaatgaatgaacaatacgttgaccggaagcagccatccaagctttatcatcttaaagaccttggtggcacggcggtttacaacgtcttccaaggtgataacgaatttgtgattaccggtaagctcaaagactggcatttccgtgatcaattgaagaatattaaggtgccaactttaattacatttggtgaacatgaaacgatgccaatcgaaactgctaagacaatgaatagtctcattccaaattcacagctagttactactcccgatggtggtcaccaccacatggtagataaccctgatgtttattacaagcacctcgctgactttattcggaatgttgaaaataatacgtttaataattaataaaaaggccgaggaaacgtttctcggtctttttattaataattcatgaatcatattttaaaaatatcttaactagaactaaaatattaaatgaatatggtacgatatttatacgataaatacgaaggaatgattaaagcaaaaacttaatacggcttcactgatgttgttcgcttaaggtgtgggacctttaagcattagttactttactcaatttatatatttaaggggaaaaatgaaagaaaattatcaactaacaactgacgaaataaagaaagaataccaattaactgattttactcacggtttatcaacccaagctgtcgaaaaacggcttgctgatgaaggacgtaatatcattgaagtaaaaccaacgccaaagtggaaactcttcttacgccagtttaacaatattgttatctacattttattagccgctactttactgaccattttaattggtcactatactgatgcgattgttatcggggcggttatcattctaaacgcgctcattggttatttccaagaatcaagtgccgcgaatgccctcgccaaaatcaaagagatgatggcgcaacatgccaccgtctaccgggatggtaaacgacaagatattgatgccgcggatcttgtccgtggggatgttgttttcctcgaagccggtgataatgtaccagctgacttacggattgtctcagctgataacttacgaattgaggaatcagctttaaccggtgaaaccaattcggttatcaaaactgatgaagcaattaccgaccaagacgttcccctcgctgatcgtgttgatatggcatatgcttcgacttcagttacaagcggaagtggtctaggaattgtagtcgcaactggtgaacaaaccgaaattggtaagatttcacaggaagttgcgcaaatcaagccaaagaagaccccattaactaaagaaattgaccatgttggaaaagtcgtttcttacattacgattactgcctcagtgattgttttcgttgtcggtttcttcctcgaaatttactccttgcctgcccttgcgctcgcagtcgtggcaatgttagttggtgcaatcccagaaggtttgcctgcaatcacctctgttatcttagcctttggtattagcaaaatggccaaagagcatcagacgattatcaaatcaatgcctgctgttgaaacattaggctcggtcgatgttattgctactgataaaacaggaacccttaccaaaaacgaaatgactgccattgagttatgggtcggcgataaacactacacggttactggaactggttatgctcctgagggtgagattctcttaaatggcaaaccagcccaactgacagagcagctcaaacttttcttagaggctggataccaagcaaatgatacggttttaactgatgaagacggcacctggcatattaatggtgaaccaaccgatggagccttcttaactctttaccacaaagcgtttggggctaaatatcaatcgccatataaagcagttgacctccttccatttgattctgattaccgttatatcgctgaattaactcgtgatccggaagataaacaacaagtaatctttgttaaaggatctccagataagctctttgaaatggccgcaaaggaagatccacaatttgatactgccaagtggcaacaacgggtagatgactggtccaaagccggaaaacgagttattgcagtcggctatcaaccagttaatggcgaaaacctaatggaagtcgaacatgaccacctctacaggggaattcacttacttggcttagctgctcttcaagacgcaccacgcgaagaagtgatcgttgcgttaaagcaaatgaaccgtgctggtgtttccgttaaaatgattacaggggatgacccgcaaactgcccgtgcaatcggtaagcaactaggattatcaacaggcccaatcaacgcaatcacaggtgcagaatgggataaactttctgccagtgaacgagaagaggccgctttaaataaccaagtctttgcgcggacgactccacaaaacaagcttgaaattattgaagcgctccaaaaccggcaaaagatcaccgcgatggttggggatggagttaacgatgcccccgccttaaagaaagccgatattggaatttcaatggggatcaagggaacggacgtcgctaaagatgctgctgacatgatcttaggaaatgataactttgcggtaatggcggctgttatcaaagaaggtcggcgaatttacgataatatcaaaaagagtatcttattcttattaccaacctcctttgcggaaggattagtggttgccttctccattcttaccggtcagcaagttccccttcaaccggcgcagttattgtggattaacttaatcgccgcaatcactatccagtttgcgttcgtctttgaaaaagcagaaaagggcatcatggatcgcaatcctcgtccagtgacccaacgattaatgaatcggcatgatttaatccagatgggttatgtctcagccttaatggcgctgttcgccttaattggttacgaatggttcatcagtgctggggcagacgttgtcaatgctacaacaatgatggttaataccattgttattagtaaggccttctacttcttcagcattcgaactgaacgatatgggctaaaagaagttggaaatattggcaagaaagcctggggcgttattggattgatgattctcttccaattgatcttcacctacgttccatttatgcaggcggccttccacgtgaccggaattagtttgctggaatggttagcagtaattgtcttctcttgcttaatcttcttatgtactgaatccgataaaatgattcgtttccgtctaaatcgacgataaaattaacgacactgaattagatttcatcttcttcagtgtcgttttttaattcataagctttcgtaatgtttcaaccaaatctatgtaagcgcattataaaatctgatatgatacacctaacacatagaaaaggagtcttatcatgaaataccaagaaaccaaagaaacacttaatcaattagttgctgatctgagtcaaatggcaatgataattcatcaaactcactggtatatgcgtggcactaactttctaaagcttcacccattaatggaccaatttatggatgaaatcaacgatcaacttgatgtaatatctgaacgattattaactctcgacggtgaaccttattcgacccttaaagaaatcgcaacccatacgaaaattaaagactggccaggaaactttgataaaacaacaccagaacgactcgcacatttagtcgctggttatcgttatcttgaggacctttatcagcatggaattgaagtgactgatattgaaaaagattattcgacccaagatatcttcattggttttaagacggcaatcgaaaagaagatctggatgctgcaagcagaattagatcaggcaccagaaattgataattaatagtaaaatcggcaccaaacgaatcgaaattcgaacgtttggtgccgatttattgtctaaaaattattttttctggttatctaggagttctttttttcatcttttaatcgcaagtcatcaagccatttcatatgcttttcttcataactacgatctttcttgataaagaagtaggctgccgcggcaagaatggcgatgacagttccgacaagcagggtcttagccgtaaaattggtaaccatgtaacaagaaactaacaatgcaaaaatggggataagatatttcccgggtaatttgaaaccgtgtgttggatattcgttactatgttcaaatttaatgacggcaagaatcgagggaacatattgaatgaatgaggctaagactgtacaactaaccaagaagagataactctgggtagcgaataaagcagagaggatggatgttaataaaattccgacccatggagcatcatgcttattcttcttcccaataaactttggcaacatgccatgttcattggccattgaagcaattaacgatggcgtgttaaacgaagctgaaaaggcaaccccaaagatacttacaagcatcccgaaaataataaaggcatatccccacttaccaatagtggttccgagtcccttcgcaagggcacctcccaaagcattagccagtggtgtcgagtaaccgcctaatttagtcccggaaagtccaacagcaatggtcatcatcaatgcatccaaaatagttacactaaccatgactgcaattaacacccgaggaatattcttttctggattcttcatttgcttagcagcaattggtaaaaatgaaaaaccagtaaaaagataaaagatcggagtaaaggcttctccaaagtgatgaataaatggcattggtccctttaaagctgcttggggaatcactggtgagaagttagctttatggataaagaagaccccaacgacaataaagatgatcagcgtaagaatcttcgcagccgctgatacattattaaccagtttaacaagaccgcgaccgaagaaattaataaccgcaaagagcacaattaagccaaaagcagcgaccccatagataagcggccgattaaagattggcaaaaaactcttgagggtagttaataaggcaacaatttccgctgaaagagtacagcaacctaagaaccaggtaaaaattcctagctcataaccggtgaatcttccaaatgcatgataagaataaagccacgctgcccctgagccggtaaaacgactagaaagatcggcataacatagggcgatcaatgagacggttattgctgtacatagcaaaactgctacagccgataagttcatgtaccgataaataacagatggcagtaaaaatgttcctgagccaattactccattaatccctaaaaagtaaattgagatgaaagatagctttttaggtactgatttttgattactgataatgaccaccccacataaaatttataattccatttatattgtagtctttttcaaataaaaaggtaaattatcagctatcctaatctcgatcttttctaaaattgttatacaattaagaatgtacttattttatataaaggatgaataaaatggcacagaagattgagaattttatttttgatattgacggtactttaattgatactattgatatgtatatgccagcaatgattgatacgttggctcaacacggtcacccagttgcgcccgacaaagtagaacaaactaagcatgacttatttggtattactggtcgagatgctcttcgcctcgctggaattagtgaggaagaaattccgaaaatgttaaaagactggtttgaccttgcttaccaacgtgctgatcgggcaaaagtgattgaaggaatccctgaaatgcttaatacccttgccaatcgtgaagatgcaaagatcgccatcgcaacttcaaaactcgctgacgaataccaagaatacttcgttaacaaatatgactttgcgaagttatttaaggttgccattacgtctgcggatactaaaaagcataagccagctccagatcctattttagtggcaatggataaaatgggagcagatcccgcaactactgtttatgttggggacacgatcaatgatatgaaagccgcccatgcagccggtgccaagtttgcaggcgccctttactcttctgcaaatcccgatagtattaaagatgcggactttccattaatgaagccggctgatctgctaaaaatttaaaacaaataaggagtctctgatgtttagaattcaaacgttagagacttctttttagttcttttaattattattcctgccttaggggctttattaataaagctactttggggccttcatataccctgccacatattcctgagccgttttttctgacatttgatagacattcacgagggcagccactatttctgacggagctgtatcttgactgcttaagaatttgactagcctttattttccttcttctctttcttctcgccgggcatccattaaatcaagctcgaacttcataaagcctcgtctcctctctggctcctgcttaatcttaataatctcgtcttgaatcttagtaataaacctactcttattgtctacttgattgcgcattaaagcaaggaagttcttgatcggttgctcatcattagtaaattctttagccaaggcattaaagatcacaacagtccgttagtcgcctagtttcaactgataattacgggtacacgccatttcaaacacataacgggcccaaccatagccaaaataagactacaatgccctctgagtatacagatgaaatagaaaattcatcttatacttggagggctttttctatgggaagaaaatctaaatactcagcagaggaaaaactcttaatcctcaatgaagttttacgaaatggaatccataaggtaataactaagtacaagattagccaaaaaactatcaggcagtggagtcttctatacaagtatcagggaatgccaggacttcaaacaagtcatcataattaaagctactctaaagaatttaaaaactcattggttgaacaatatcaacaaacagatgaggtattagatttatttgcgataaaacacggtttacgatctcaaaggcaactagaacaatggattatccggtataatgaatctaacttaaaggcctatacgccaagaaagcgagattcaaaaatgagtggacgaaagactgactttgaagaacgacttactatcattgaagagttgattaagcatgatgtgaactacaattgggcggttgaaaagtaccatattagttaccaacaagtttatggctggtatcaaaagtatcgcaaaagcggtaatgacccagaatcacttcgtgatcgccgaggcaaagctaagccagaagagaagtggctggaagttgaccgactcaaggcagagaatcgcttattaagggctcagctagaaaagcaagagatggagattgcattcgcaaaaaaattaacagaaatacgcaatcgggaggtggaaaaggactccggtaccaagccatcaaagaactaaatcaagaaaatggatggtcaattagccagttgtgtaaaatagctgattcttcgcgagatggttattacaaatggctcaattgaaagccaagtcgatatcataatgagcaagcagagttacttgaagcgattgtagagttagaagaagaacacaattggacgctgggatatttagcgatgactacacagttaagctttgaaaaccgtttaagctttaccgctggattaaaacgaataactaactgcatgcgtaagcatggaattagagcaaatattaggaagaagaagcgcaatcgaattcaacgccatgaagaatacatcaatgacaacttattgcagggacaattcgaccgtaaaactaaaaatgaagtgtgggttaccgacacaacggaagtagcctacggcggacacacacttcataaagtacgagtacacgttattttagatttatatggtcgttacgctttaagctacaatatttcagacacagaaacttcatcagcagtaattgaaacctttaatcgtgcttttatggttgagcctgatgcgcaaccaatgatccatactgaccgcgggtcagcttactgctcaagtatgttcaacgactacttagtctctaaaaattgtattcatagtatgtcacaccccggtcatccttgggaaaactcacccatagagcgttggtggaatgacttcaagctaatctggattaacaaacaccctcgtcctaagacgctagcagagctagaacaactcgtcaaaggagtcattgaatactttaataccaaacgcgcttacacaagcaaaaacggcttgaccgcggaacaattccgcaatcaagccgcctaaaatttttatctaattgatctgtatacttgacgggacatagtgccatatatccccaccgcttattattttttctgggtgtaatttcgcgtgaaactagctgatgatacttagcttcgtatgacatatcgaacattctcgtgaccctaatgcattaacttttccacaattaggacagaccaaggcaagcatctgccctttaagtggttttccacaattctcacagacttcggcatcgtctggatttaatgtgttacagtagggacattttttcatttagtaatccccattgaagagctgtgcattgccattcgcttatcgggatagagtttcttagctagggcggttaccgcggtcggcgcttcaccaaagccggccgcaatcaatgcaactttccccgggtaggtcacaccatccccgatcgcatataccccttcagtactagtttccatcattgaatcaaccttgatcaagttgtgttctgctgctaagtcaagggaccactgattcaaggccgcattattagaggtaaacccatagttaaccacaatcttatccacattcaattgtgcttcgtcgtcactccgcatcttcttaagatcgagcgttaccgtttcatcatcttccaccgttaatgctcgtggtaagaaaggcgtatccaattgcacagatgattgtttaagctgggtcacagtatgctcaaggccacggaactggtcccgtcgatggacaaggtggacttccttggcgacaggttcaagcatcaaggcaatatcaatcgcggagtctcccccaccaagaatggcaacccgcttgtccgcataatcagctttatgattaacaaagtatgaaagctgcttaccttcaatctcagctgccccttctaaagcgagcttacggggagtaaacgctccgttaccaagagcaatgattactgctcgtgaccgggatacccgctttgctgatttgatggtaaaggttccatcatctcctttgatgacgtcctcaacggtttcgccaaggaattgatcaatcggtgccactgccatttgttcttctaacttagcgatcaggtcgtgtccagttacacctggcattcccgctacatcccaaacttgtttttcaggatagagtgcccctacttgtcccccaagttgtggaaggctttcaattagctgggcatctaattcatgaaggccgcagtaaaatgaagcaaacatccctgctggacctccaccaataattgtcacatcataaattttctctgccatttctcctctgatcctttcattttcatctctagaagtattatatcatctttattttttctaaaatttcgtaagcggtctcaaattttaattgtaattattcaaaatttaaattaacatattatatacagagattgattttgcttaaaattggaggaataaatactatggcaaaacgtaaaatgattcttgatttagatactggtgttgatgacgctttagctattgcctatgcgctcgctgacccagaagttgatctaatcggaattgtaagttcatatggtaacaacctattagatgtttgtgccgaaaacagccttaaattattggaattattaggtcacactgatattccagtatttaagggtcttccacattcatgcactactgaccactttgatgtaatgcaagtttcaaaggatatccacggtgataacggtatcggtgatgttgaattacctgcgccaagtcgggctcttgaagaacaatccggtgttgatttctacatcgaagctgctcacaagtatggcaagaacttaatcatcatccctactggtccaatgacaaacttagctgctgccttgaagaaggatcctgaaattgctgacttgattggtaatgtcacattcatgggtggtgccttaactgttgaaggtaatgttactcctgtcgcagaagctaacattaaccaagatccaaaggctgccgatgaagtaatgaagtccaacttgccacttacgatggttggtcttgatgttactcttcggaccctccttactaagaacgaaacaaagcaatggcgtgaattaggcactacttccggtaaggcttttgctgatattaccgacttctacatcgacgcttactacaaccttgatattgataagcgtggttgtgccctccacgatccattagctgttggtgttagtattgacccatcatttgtttcaaccattagcttattcatgaaggttgtttaccaagaaggaccttactatggtcgaacaattggtgacaacgctaagttaaacgatcctaaccctaatgttaaggttgccgttaacgttgacaaagaacgttacctcaaggccttcatggatcgcttaaacaagcttttcaaagaaaactaaatttaattaagaggctgttgaaaaaacttagtttttaacggcctctttatttatacaaatattgttaagatatcgtggaaattaaccataaggctcgaggctaagtccgtacgataatcagcccgtgccgtgctaatcaccgttctatccttagcccaccgccttgtcgagaaggttaattcccactcactttcattttacaaggcgttattctcctgtttttcttcgatagttgttataataaaatttgtaaaggattgtttttgattttactaaggaagtgtcttatcaatgggtcgtttagataataaagttgcaattattactggtggttctaaaggaattggagctgctgtcgcaaaaaagtttatcgaagaaggcgcaaaggttgttttaaccgctcggaagatggatgagggacaaaaagtcgctgaccaactaggtgacaatgcgatctttatccaacaagacgttgctcggaaaggagactgggaccgggtaatccgccaaactgtccaagtctttgggaagctcaatattgtggttaacaatgcgggaattgccgaatacgccgatgttgagaagacggacgctgaaatttgggataaaacaattgccgttaaccttaccggtacgatgtggggaactaagctcggtattgaagcaatgaagaacaacggggaaaagaattcaatcatcaatatgtcatccattgaaggactaattggtgatcctgatctctttgcatacaatgcttctaagggtggtgtccgcctcttaactaagtccgctgcgcttgattgtgcccggaaaggctatgacatccgtgtaaatacaattcatcctggttatatctcaactccactagttgataatttggtcaaggatgatccaaaagcagaaggacacctagaaagccttcatccccttggccgtcttggaaagccagaagagattgctaacctcgctttataccttgcttcagatgaatcaagctttagtactggttcggaatttgtcgctgatggtggctatacggctcaataaaaaacaaaacaaaaggatcattgccaaactagatgacagtgatccttttgttttaaattaaattccgaattaccaatgaaactgccaaaatcaatgatccaaccccgacaattatttgcataagacggccaggcaggtggcgaacaataatcggtcctaagtagcccccgattacatttccaatcatcaacggaataacataattccaataaattgtcgtctcaagtgcgaacactatccaggatgttgtatttgtaacagtcatcgcaacattttttagcgcattattaactgcaaagctcttttgccgattgatcactgtcagcaaggttagcattaacactccggcgccggcattaaagaagcccgaatagatcccaacaataaaaataccaatgattgataaaaattggccaatccgtgatttaccaaataatttactgtttcctgccatcgtccctgtactttgcttcggatgatggggaaataacaagataattccagctaacgcaatgcataatggcaccagttccgcaaaccacttactggggacagcaaacagtaaaaaagccccaataacggaaccagcaaataccaatggcagaataatccataattgccggcgattatgctctaattccttaaacgatgaaaagaccgaactatagttaccagtgactgtcgaaaaagcactcgttacgtttgccatcactggcggtaatcctagtgcaagcagtgatgggtacgagactagtgatgctaaaccagcggctgcactaataatccccgaaagaatcccaattcctagtaataataaaacaaaaactactccactcatttcttaaaccatcccttttaaatgctagtgttaattgtaaaccacttttctaagataagtaacctaattaacgatttgcatttcgttataatattagctatgataatagagaataaatctggggtgccaaacggctgagataatacccattgaacctgctctggttaataccagcgaagggagattcagtgatattaacttaatgattaactccatgattttttgtcatggagtttttttgcccttatatcttaaggagttttattatgactaaacgttcattacatttgcgtgacattattttgcttgccctaattggaattatttttggtgtaatttattttgcagccggctttgtctataacgggctaactgttctgctgacaccaattggttatggtccaatggctaacgatttaacaatgggaatctggtgtatggctggaccgcttgccggctttttgcttcggacaccgggagcggctttctttggtgagtttttgggagccgccgttgaaatgcttctcggcgatcagtggggagcagccaacctaatttctggagcagttcaaggtatcgggtctgagttaggttttacttttacgctttataaaatgtataactggttgaccttactcatctcatccctcacccttacatttgttacctttggctgggattggttccgcaatggttataatcacttcagcggacaaatgctcattattatgcttattgcgcgcttcatttcaatgtttgtcttctctggaattctggttaaattgattactaatcttctccaacgagcccacttaattaaacactaagactatgaaaaatatacgatttaatgatctttcatttaattttgatcagcaaccaatccttaaaaatatcaccgccgaatttacggccggaaagattcacttacttactggggtctctgggagcggtaaatccaccattctcaagttaattgctggtctcctgcctaaatatggtggtgaaatagttactggagcagtcgatgtaccaacagatgctcaaattgggatggtatttcaagatccgttaatgcaatttgcccttgatacgccacgccacgaattagaattcaccctagaaaattgccaggtacccactgacaaaattccagagcgcgttaaagaagctttacaatttggtaaagttgatgatcttgctaaccggttaatcaccactctttccggtgggcaacaacagcgcgtggctttagcagctgctacagcaatgcaaccaaacgtgcttttattagacgaaccctttgccaatattgatgaagaaaaccgccaacttatccttaaacaattagtccgcctcaacagtgactatcacacaacaattatcattactgaccacgatttgcatggttacgagcgactacatccactggtttggcaattagctaaggggcgccttgcccagctttccactaaaaatagtaaccaacttttgacagcgagcgctactccccaaattaccactgctcttcccccgtcaaccttacctgtgattatcaaatttgatgaattagcaataaaaagagggaatcatttcttacttttaccaaccaatttaggcattgttaaaaataaaataactttattaacggggccaaatgggattggtaaatctacccttctaaaagcaattgcccgacttttaaaatatgaaggaaagattgactatgcgggggaaagcattcaaaaaatatcacctgggaaatattacaagcatctgggattaatttttcaacatgcaaacgatcaattcctaaatgtaactgttggcgaagaactggcattgggctttaagacttgccagaatccctattttagccaacaacaagtcaacgaagcattagcagctcttggtctgaacggaagagaagatcaagttgtttattctttaagcggtggtcaaaagaaaaagctgcaaatcttgctgatgttaatgcgcggacaagaaacattattactggatgaaccattcactggtttagatccagcatctttaaagactgtcctacaactaatcaaagcatcccaaaaagaaaaaccacagactttgctaattgttagtcatcaattaagcggacttgatggtttcattgattatcatcttacaatgaatcatcaacgtcttaattatgttggagggagttatgaatcctagtttaaaattattacttgttattttgctttcacttgagctgacttttgtgactaagctgtggattaacctgattgtcattgtagtgtgtttgctaatccttattcatcagcgatttcactggcgacaattttgctggttggcttttgtccctctctttccggcactagctattttcattacaattgtcttctttagtcctagtcatagtctcttcgatggaaccgttcttttcagccgactctatgtttatgtctgccttggaacagtctttacgtttacaaccgataccttaacgcttgctcgctcattagaacaaaattgtcaccttcccagcaaatacgcttatggggtgctcgccgctcttaatctaattccgaaaatgaaacaagccgttacaactatttatacggccggacaaatgcgaggtgttaatttacattggtggtcaccaacgctctacttcaaagcgattctggttgcgattcaatggtcagatcaattagcgcaggtcatggaatcacacggtttcgttgaaggacaagcacgaacagctaccgtggatatcccgattaccagccacgattggctttctttttttagtattatttgccttgtacagataattgtaattgcgctcccttgagttttcatgcgataataatataaaaagaaaggactgatatagtgaacgataataatttaacggaccggatcgttaacgctttatcctatttaagcatcttatttttaccagttatctttccactaattgtgtggataattgccaaaagcagtgatcgaccaactattgccaaaaacgctcgctatgcattttggagtcaaattttcccattgttatatgtaataggtgcaattttagtctttagtgtcttttcattaaaccccgctaacttccacgggggcgcattgtttggaattctcctaacatttgctcttttattagcccttttgttatttatttataatattgccatggccgtaaaaatgctgattggccgtgaataagcttaagtaagagagtagagaccaggaaatgctagtattttcccggtctctcattttttatccaaaatatcaagtgaggtgattaatcgatggaaatgattttaggcattgttcttctattgactgctgttgttgcagctaatgttgttcatcttgtttaccctaagattccactatccatctatcaaattattgcaggaattcttttagcatccctgcctactgaggccactaactttaccatgcatccagaattattcatgatggtgattattgctcctttaatgtttaatgacgggcagaaccaatcattccgttatctttcaagcaatatcaaatcgatcctatcaatgactgttggattagcacttgtaacggtcttgattactggtagctttttacattggcttcaaccagcaacgttctccttagcacttgcctttatgttggccgcgattgttacgccgactgatgcggtcgctgtaaagtcaattactactaatatgaaggtaccgaaaaatgttaatggtgctctggaatatgaatccctctttaatgatgcatcgggaattgtgcttttagacttggcgctggaaacctaccgttctggacaattttcgcttggtcatggaatctggatctttgtttatgttttctttggcggaattatcttcggagcagtgttagggagcctgttaattagtctccgtattagtttgatgcggaagcacgttgatattggctccatcgttattccgatcaacgtaatgactcccatcgttgtttactggttggctgaagaactacacctttcaggaatcctagccgtcgttgcagcgggcgttgttcatagtatcctctatgatcgaatgcggcttacatctactaaagtacaaatgtctactactactatctggaatatcattagcgatgcgttaaacgggttagtatttgtccttttaggggtgatgcttccgcaggtacttggaaggacttcttggcaaaatctgggtgcaatcgttgccttagcctttgctatctatattattacaaccctcttaagatttttatgggtccggtttaagttcgtcaacattcaatcgactaaccttaaccgtgatagtctcttaatggcgttaggaggaattcacggaacgatcactctggcattagcattctcgttgccagtactgattaataaccatcaatttgctttccgtaattcaatgatcctgattgccgcaattgttattttgattagtattgctgtcggcgcaattgggtatccaattattttaccgcctaaatctaagagctattcgaagagtgaatttcaaaaagaacttattaaaacagttcaatatgctattaatgagctacggacttcagaaaaatattcaccagaaaaagcggctgttattgaccaattgagtagtcaaatgacgcaataccatgaattcaatcgcaacgtttatagtcaattaatgggtaaagctcatcaaattgaattggctaccttagaccgccttaacgaagaaggccgaatctctgacaaggaggccaaattcctcgttaattttgttacacggtcgattttccgcgtaaataaacacagctttcttgaattatgggtcatcttatggcaccggttaaaatggcgttttattcgctaccgccatctcaaaaaaggctcccgctacaatgtggggccaaaatatcaattaaccaaggaacagcgcactgaaacagcggagatcctagaaataattaatcgtgaaatcgataaataccttcattcgattgaaactccacagaacgcgaatgaagttgccatggtacgacggacgtacttccaacgaaaacgattcttcctgcacgatatttcgatggataccgacctcattacttctttatttattgaggcatttcagcttgagcacagttatgttcaaatgcaacttgctgatgaccaattttcacaagaattggcaaacgcattaaacgaacagatctcgactgatgaattggtttacactcaatcattagactaaaaaaggaaattgctgcaaaatcttgcaaagcaatttcctttttatgtttaaagaaatgtaagtaaaaacgcaatcaatgctggtaaaaattgaattagaataatttttttggttgcagtaagtgcaccaaataatgcaacaaccatcacaaaaaccaagagcatttgccatactaatactaaggttgccccactaaataaccagtaactggcgatgatagctgctcctaaggctccgttataaataccctggttagcgaatgaaacccgggcttcatgctgttgcgtaaacttaagcggtaagtcaaacgccttggcttgctgtgccgggttaccaaagatttctaaggccataatccctaaatgttcgattgcaacaaacatcgtaacaataattgcaagcatctttttcctccaactatttaatatagtgatctaaaaatcttgtcaaatggcggcgatattcgctgggatgggtcgcatacgactttgcgtgcgctgcccctggtactacccacaattctttgcttccctctgttgcacggtaattacgataaaccatttcagttggaacaaaattatcttttgctccatggataaatagcattgggcgatgattatgatgcaacatatttaaggagctagcttcatgaatgtaaaaaccattcttcacccgattaattaaactcatcgtacttattaatggcacccgtaaaaacttcggaatcccatataaattaccagcttcataatttaattcatcattaaggctcgtatatccacaatcttcgacaaatgcttttacttgtgggggaaggttaatgccactagtcatcattgttgtcgcaccacccatgctgaccccaaacaagactacttggctatcttccccattatgccgaataagtttattaatccatttgcgaatatcataacgctctggccatccatagccaatgtattttccttggctttgaccatgagcacgcgcatctggcattagaacattataccccatctgatggaaaagcgcggcatattcgcccatcttctccttgtcacccataaaaccatgggcaattaccacatttttagttgttgatttagcagcagggatgtaatcagcaactagtttataatttccactagccgatttcattgtccatttttcttttttagcatgcttaaaccacattttctgctcatacaatggatcatttcgtgagattttagttgaattattaataaaatccttatgccccggtaccattgccaccgagaaaaaatagctactagcggcaaagattgccactgcaattacgactacaattccaatgagccatcgccaaggatgccactgtttttttttgtctttgttctcaaaataattaaccccatgtcgtattatttaatcaatgcgcctagtttagcacactttctgttattttgcatattcttttcattcaaaatcgtgatgctaatgttaaaatagataatgatatattaagggagtgaaataatgtttccagaacgcctacgagcacttcgcaaaggacaaaagataaccttaaaggagcttgctacccacctcaatgaaaaccttggccccaatgaaaagccaaacactgcttcacaaatcggtaactgggaacgcggtattcggaccccgtcatacgttgaagcacgaaaactagccgagttctttgatgtcagtctggactatcttaccggaaaaactgatcgtgatgattttgacttagcaaaattatttttctctagtaagaacctgtcgtttaatcaaactgtactttcaagtgatgatcgatatgaaatttttcaactaattgatggttacttaaagggacggcataatcgccgggatacagacaccttctatggtaagcaagagcaactagatttaaaacttaaataaggagtttgtgatgaatcctaaaaaattaaagcagctaaaaaagcgggtaaaaaaagctcatcaaattgttaatgagccttcctatattcaagaactaaatacttaccgtgacctattcgatgactttcctcctgtaaaatacctcattaataatgttttagaaagtgatcgactactcaaaaacggcttattgccacaccctctaccaaaattattattgccggataacattcaagataccattttcaaaaaggttaataaacagttcccccaaggtgatccacgcggtgataaactttggaacaaatatagtgaggcgttgccaaaattggataaggcgttgcgcaactatcgtgattatctcgaagaaacatacggaatgtggtcatacgtcaatgcaccttttgccaaagcactttctgattatttaggcggggcgccgacactggagattatggccggtaatggttatatttctaagggattacgcaataacaatgccacccaaaagatttatactaccgatagtcaggcatggataaaagaaaacgaaacgggcaaacaccctgtcactaagattgagaagttggacgctctagaagcaatcaaaaaatacggtgacgaggtcgaatatgtcattatgtcatgggctcccgataagggtgaaattgactgggatgtcctgcaacttcttcgttcaacataccccgaagtcaaattattagttattggcgaaaaagatggcgcaactaactctaaaaaattctggcaagaggcacaattgagtcaagacgatgaattacagaaagttaatgctaacttgcactcgtttgacttgattgatgaacagatttatctagcgaaataaaagaagttgaggttaaaagagaacaaaagctttctcttaacctcaactttttatttaatcaattttagccactaattttccgactacttcatgatttttaatcgctgttaagccatcaataatttgatcaaacggaatcaccttctcaatcaaaggctttacatccccattagctattaattttaacatttccgcattcattcggcctaaatcagcctgctgatatggattaccactgagatgcgccccaccaagattaacgacatccatccctagaccgcgatcaaacattggaacattatcaagtgaaggaacgtcaacaatcgttactaagcgtccattgtaagctagccgtcgcaaatcaagttctgcttcttttttgcctaccgtatcaatgatcaaatcaacgccaagcccatcggtgagagcggctaactctttatccacatcttcagtttgatagttgatgattgcatctggagcgagctgctttacgtagttacatttactagatgaaacagttgtaaataccttacagccatgaagtttagcaagttgaatagcgatactgccaacgccacccgcaccagcatgaaccaacacggtattaacattggaaaaattagctttgcgttctattgcttcataagctgttaaagccccacataaagcactagcagcaacttcataggaaacagaatccggaatcttagctaattcataagtcggggcagtcacatattcggcgaaacaaccatttttcgttaaatcaccatgtccagatactcggtcaccaacatgccaattcgtaactccttgaccgacactaacaatctccccagcaacgtccaatccaaggatatgcggatactgccaagcactaacgccgccttcaacgattttatagtcgaccggattaagcccagcagcatgcactttgattaagacttcatgttcagctggcgtaggaaccgagacttccgcaaaattcaaatcttgcaatgaacgatctgctgctttttcgactactaaggctttcattttttcgctctccttaattttataacaattattatagcactttgcctaagcattcttcatggccatcttattaaggtagtgccaaatttgcgaacgatatttccgtaatccgaataacatcacaagataaatgataattgctagtgaaatccaaacaggactttctgatataaaggcagcaaaaaccaatgcattcaatgggcgtgctactaagttaaagcttgttaccaagaccaccccggttggaattgcaacgccatagtgggccactgctgcagtatagaccggactgagccaactagccgcatataaacctaaactaaaccacacaattcccgtcgcaattacttttaagatatttccacgagttaccgcgacaattgattcaatcatgtacggaattgcaattaaatcaactaccggaagggtcttattgccaggaaggataaaagcaattaaaaccataatcgggattaaaatgattcctgaaattaaagttgctgattccccatagccgaccccatcatccactgctaggaaccaccgctttttatcataacggctatttttattttcgccatgccgtttcttctgctgttcatcaatttcagtcgcgatgggaataaatgcctttgcgaatacgtttgtaaccaggggaaagatcgccataacggcagctagttgaatcgcaaatttagtaatctgtccccacgcgcttattttccccagtgaagataaattacccaggattccaattattaatcctaggataattcccattgtaattggttctccaaagacacctagttttttctgaaaatctttaggagtcatcttcactttgttaaatcccagtaaattccataacggatctaaaataatcgctggaaccacttgctcgatattatgtaaggagtcgacggtggtattctcaattccataatagtctgcccaccggtctgcttgaatctccgctaagactagtgagtacaggagcataaaaaattccagccctaatgatagccaataattatgagttacataaaaagctagcgtgccccaaatcatatacccaaaattattccaaatattagaaggcagaaatactttggtaacgccaagtgcaaataaaattaattcagctagtaatccaaaaacaaaaaacgataaaccaaccgttgatccaaacgctgctaatgaccctgcttgccagccgatatcaaccactggtagtttaatccccgtattatcaaccatttggcggacaatcttagtcaccactggcgtaaattctgtgataatccaggtaaaaccagttaaaccgacaccagcatagaaggcactcatcattgctgtcttaggcttcactcgtagtaataaggcaatgataaaaattattattgggacaactacacttgcgccaaaggtttgaaaaatagtattaacttcttgaagcatgttttatccctccatcgaataaactgttacctatattttctctaagaccgatctttttagcaagacaaaaggtttatcttcgtttgctatagaaatgcattcagaaatttgctacagtatgatgagtttaatttattagggagggtacattttatgaaatatcgtttacaagctattatttttgtcttcgttgcctttatgcttgggtgtaacgaatatatgattgtcggcgttttacctgatattgctcatgaataccatgattcacttggtaagttaggcctacttgtaactgtgtttgccttggtttatgctatctttactccgattattacttcaatggcaaatcggtggcgacgacatcatgtcttattagttctcatggtcattttctttatcggcaatacctggacagcgatggcgccaaactttatttcaatgttgctttcacggattctaaccgctagtgttgccggtgcgattatctcaatggtcctcgtaatggcgagctatgttgcgccgcgcgaaaaaagagcaagcctggtttcatgggtttttgctggatttagtatcgcgtcagttatcggtattccaatcgggaccgttatcagcactacccttacttggcatgatagtttttggatgatttctggaataacaatcattgtttttgtcgccttactctggctcgtcccacgtgatacgcctcaatttaagagtacccttagtaaacaatttgtgttatttaaggattctcgaatcattctcggtgttagtttcatcgttgctacttgtgcggctgactacacaatttatacctatattcgacctttaatcactaacgaaatgggctttgataatacttggttaaattggctcttattcggaatgggaattttctttattattggtaataaatttggtggctacctggcggaccgtggcggaatccaccgactcagtggaatctacgcggcaatgacagtcttatttctcatctttggccccgtcttaccattcaagtggggcgccattattattgtggctgtcttatgtattgccttttcatgctatggctcttccacccaattgatgttcctcgatattgccgaaaaacaatatcctcaatcacttgacttagcttcatctctaaactcgatttttgctaatattggtatttcgctgggctcttttactgcctctcaggctgtcaccttcactgccatgaaaaatctcggttacgttggtgcagtctatgggcttctcgcaacaatactagtcatcgtccttagcaaaaaatatacggggatgcgcaattattaatcttaactttgagtacagatggattttctatctgtgctttttatttcccgggaaattaatatgcaactaatagtagcggggtgagcaattgttgttatctaaggattctattgaccttttaagcagatccaattaaattctaaatatagattttgaaaaggagctttttgctatgtcatactctttcccgcatcaactgctcaaattgcggactgaaaaacaattatcacaagctgaactagctacgcgcctgtttgtttcccgccaggccgtctccaaatgggaaaacggggatgctgaaccaagtatcgacaagctaattttgcttgccaaagtttttaatgtttcattagaccgcctcatcctgggaacaaacgactttaatcaaccactggtaaaacttaataatattgttaaaacttttaactcaccagttctcaacagccttgatttaactattcagaataatgaacgcattgccctccttggtagtaatggcgctggtaaaacaactttagtaaagataattgaaggtactttgaaacccaacgaaggtactgttaaatggtattttaataaaaatgattctttaaatatcatgtcccaagaaaatgttttaattccgaccctaaaagttaaagagcaaatcagtttgacagccgccataactaaggttgattcaaaacaacgaatcaattatcttcttgatcaatttaaattatcatcccagccaaatacaattattgcgaaattgtcaggtggacaaaaacgtcgcctttcgctcttacttagcgtcctccgtcagtccaaacttctgatcctagacgagccgactgttgggatggatttagaatcaattgactatttttggcattttattgaaaaggtttcaggaagtattttagttattactcatgatttcaatcaaattgataaattcttttcccgtgttctgctccttaaagatggccaaatttctcacgacatccctgttaaagaaattcaccaacataatcaaacaatcgaacaatggtatcgtcaacataatcgttaggagctttcttatgaatatcatagcaattcaactaaaacaagttttacgcaatcgtcgtttctttctttttactattctcctgccaggtatttggtatgtatttatgattcaagttgctagtacatctctccccgctactggcaacttccggcttgctttactcttgcttgctctcctgatgggaatactcggcaattcaatcgttactttcagcaaacgcatttgtagtaataaggacttctatatttttcaatcgcacattagccactattctttgtggaactatttattttcgcaattaactacccaagtcatcataaatttgttcatcaccatcgtaattatgattcttgccatttttcttcatactattgagttcaactttattactatcactagtattttattaaccaatattatcggaatatatctaagcgtgatcgggtttgcaattgggctttcctttgacgcaccaactgttgatgccgctggaaccccaatcctatttataatcgcaacttttattattccgtggaaacacctcttaccagctaattcttttattgatttttttactaatatacaaaagctatttccaacttattatctttatgccgaccttgatcatctatcggttagtcatcttgggctactatttgtaactgcgattattactctgctaccttggcttggctttatctatcgaaaattaatcaattaaaaaaaccggaatacttagtatgtttagtactaggtattccggtttttcgtgtattgatactatctcaagtcaatcagcactgtccacatggccgattaactggacacctcacaatccggtgagttaatgtgtctcacttgccaaaatgtcaatggtagctcttagggtcgctaccagacctctcgactcatcgcaaactataatttagcatatttgacccattgatgcaactcttatgctcttgcttccattatatctgcaaggtgttcggctacccattcttgagctttagtaaccaaatcagttgtctttccactttgatcggtttcatttgctaattcatcgatccgcaatcccgttttattaatatcttcactctccattactaaataaagattaacagggtactcgatctctttatccaataatttaacatctaatcgctctgcctcatccatcggtatgttgattaagttggtttctaagcgaaagctaactggatcaccttttttcattttaatattcatcttatattgaccaaggtgtcccgtatcaagctgttcaatcataaaattaatcgcagttgttaatactgttttttgctgtgattgggcagcagttttttcaacttcttctgtcacaacctgatcgctcgtcaactgtgacaaataatcagctactgacatcttcatttttttatttgctccttcattttttcaattttagcttttgtatagtctgcacgctgttttgcaccataataaacaccagcagctcctactaaaattccaacaatacttagtgcttgaataaataatccgtaggcactttctcgtggacttaccatttgaaatgcggctaaactagcgattgcaaaataaaggtttactaaaatcgttgcatatccacaaaagcgcatctttaaaaacgataatccgttaacaatgattgctaaaacgataaagaggagcagccgcggccatacagatgatgatgtcagcgagtgaccatgctgaacaaacataaaagcatcaaggactaatgcaattactgctgctactgatgttacaataacaactttttcattatttttcatttattttgccaactttcttttttgctatccccgcggatgaccaatatttttacattccttaattaacaaaaaaggaatgtaacgattaattacactcctcattttactaaattaagttaaaaagctcaattatgcgagtaaatcagctacttcagcggttggaattcctgtaatatattgttgggttccttccgcttcaaggactttagcaatttcatcatggtcatacttaactccttggagcttttctgctaattggttaatatcctgcgggccaaagaaatcaccatagaatttcacgtttttgattacgccatctttaacatcaaagcgggcatcaattgtccccatatcaaagtgttttcgccgcttaaccgtaaattctggcgacttaccatagacccaatcccagttgttatagtactgctcatagatcttatcaatttctttttgatcctcgggagtaaccacgtattgcttatccttaatctcctcaaggtcgtcaacatgaaagagaccctttagcaattcgtccctaaatgttggcacatcaatatcttggtacttttcatccaagtatgggcggaggttcgtaacccgtgatcgaacggatttgatcccctttgaagcaatcttatcttttgccacatgaagggcatccgcgacgacacttaagtcaacgtcaagcattagcgttccatgggaaaacgtctttccattacgtgaatacatcgcatttcccgagaatttcttaccatcaactaaaatatcattacgaccgctgacctctgcactggtagcgcccatttgatgaagaacattaacaattggctgggtaaacgatttaaagtcaccaaattcctcactatcgcttgggaccacaaaactaaaacagagattccctaagtcttgataaacagcaccaccgcctgataaacgacgggttacccggatattgtgttcttttacataatcatgattaatctcttcaagcgtattttggtttcggcctacaataatacatggttcttcataataaaatagtactaaaggctctttcccaaaatccttattattcattaaatattgttctgtagctaaattcattccaatattatgagaagtcattgaaacataacgcataactagcaccctcttataaaaacatcaacataaatagactaaagttttacttttgtcatttagtcatccaattgtagtgtacgtcttttagtaagcgtttgcaatacattatcaacaaagtgaaaaatactttcttttttacatctttttagggcgaaaacattttataataaaggtataaactttcggaggtgtctattatgacagaaatttatccatacaaacacattctcgttgctgtcgacggctcaaaaattactagtaacgtcttagaaagtgccattgattctgcactacggaatcatgctagccttgatatcttacggattgttcaagtaacgcaactaactgatggctatagcaatgcggcccttagcaacgaagaaacatataatattgttaaaaccaccaaggaacgactcgatgacttgaaaaagcgtgcggtcgatgcgggggttgaagacgttaacgttcatatccgatttggaaatccaaaacgtgttattgcccatgaatttccgtcagatcacaatactgacttgattgttctcggtgcgactggtgtatctggtcttgaacgctttgttcttggctctgttacccactatgttagtcggatggcaaaatgtgatgttcttgttgttcgcaaaaacgaccatgttaactaggtgaaaaaacggtgaaacaaattgttactggcatcgttgctcatgtcgatgctggaaaaacgactttaaccgaagccctcatgtataaaaccggcgctattcgaaagctaggccgtgtggataatggggatgcttttttagatcctaatacgctcgaaaaacagcgcggaatcactctttttacccatcaagctgaactaacctacaatgaccttgtgcttacccttctcgataccccggggcacgtcgattttactagtcaaacagaacaagtcttaccagttcttgattatgcaattcttgtcgtttcagccactgatggtattcagggatacacgcgcacattatgggatcttcttgcgcgttatgatatcccgactttcattttcattaacaaagaagacgtgattggtgctgattctagcggtgttatcgagcaactgcaaaaagaattttcgccagcttgccttgattttgctgatccattaactgatgaagttcatgaaacaattgccatgcaggatgatacagttttagaaaactacctcagtactggcagtcttagcgatcaaacaattcaacaattgattaaacaacgtaaagtgttcccttgttatcgtggagcagccctaaagctaactggaatcactaatttcttaaagggacttgagaaatggactgttacgcctgagttcgctgatgaatttacagcgcgggtatttaagatttcccatgatgacaagggcaacagacttagttgggttcgcgtattcggtggcaaaattccagctaaatcagttttgttaaatgaagaaaaagtgaaccaaattcgaatatataacggggctaaatttaccccgagtcaggttttaagtgctggtcaagtcggtgctcttactggattaacttctacatcccctggacttggtcttggtaaaacaaagccactcccggcaccagttataaaaccagtcttaaattatgccgttaaagttgataaagaggaccttcatgcttgtctcaacgccttaaaagagcttgaagatgaagatccacaactacagatctcttggcatcctcacatccaagagattcacgttcagattatgggagaagctcaacttcagattctgcaacaattgcttcaagaacgttaccaattaaaagttacatttgatgagggaaacgttctatatcaagaaacgattactaacaaagttgaaggggtcggtcactttgaaccattacgtcactatgccgaagcccaccttcttttagaaccgggaaaacaaggctctggaattacaattagcagtgattgcagtcttgatatccttgatcgcaattggcaacaccagatcttaactagtttacaggccaaagaacatttaggggttcttacaggagctccccttaccgatgtcaaaatcaccctcattggtggtcgcggccatattaaacatacagttggtggagattttcgtcaggctagttggcgagcggttcgccaaggattgatggaattaaagggacaaaacggatgtcaattattagaaccttggtatgctttccaccttaaagtcccgaatgaccaagtaggacgcgcaattaatgacattcaacaaatgcatggtacgttcgagcttgatgaagctaatagtcaagccctaaccctgattacgggaaccgctcctgttgtgggcatgcgcgactacgcccaaagcgttcgcgcctacactcacggccagggtcagctcgagcttgttgttgctggctattatccatgtcataatgctgaagatgttattagagatgttaattatgatccggttgctgacctagaaaacactcctgattccgtcttctgtgcgcatggtgctggtttccccgttccgtggaatgaagtcccaacaatggcgcattatccatatagaaaataggttgttgatattgccataaataaagaggagctagaagaaaaatttcttctaacccctctttatttttcattcaattgtcaatagcaatccatacaatgcacctaataaattagcttcattgccaaactttgcggtcattatttctggcatcgtaacatcatcatgaagacggtaatcactcttttgcagaatcataaattgcttctttatttcatcaattaaaattttttgggcactaatgccaccaccaatgagcacacgttcaaggtcaacaactgtctggatatttaaaatcaaaacggctactcgtcgacaaaaaccttcaaataaggaccaaataactggattatgacgattaatttctttaaatactcgccggccatcagtcttatccttaatatcacaaatatcagccatggtttcaatcatcttaactgctgaagtagtagcccccattgtcgaatagtgaagttcaggcgcatcattatcaatgatcatggcacttaattcaccggcctgaaaatgcggtccgtgcaagagctggttattaataacaatcccaccgccaactgaagttcctaatgtaattacagcgccactactgataccgttgagattgccaagccacatttccgccaatgtcgcacaattagcatcattaccaacatatactgggcaatgagctcgtgattctagataggctgcaaagttaaaggtccccataaagccaagggcaccagtaaactttacctctcccgtcgccggattaacgactcctggaagactgacacaaatcgcagtaaccttgtctaaaaccggctccacaacagcaaagattgcagccagaaatgcttctttttgatgaggagttgggacatgatttttctcaaaaatattaccagagtgatcaattaacgcactctttatctctgtcccaccaatatcaatactcaaatactgtcgttgcataactcctcacctcatctctcttatattatacacgactccgctgctgagggtaccatatacaaatactgatgaataagcccaccatggtaaaaggcaaccaactaaagccaagttgatacaagggaaagtatttttctgcaaaatgaattaatgacatactaaatgtggtatcccgtaaaaccggtggaaaagcatttaccatatcaaaaaacgcaggaatcattgttatacctgtcgtgattcggtaaattaacgaagctcccttgaataggggcgaaaaaatacctagtaggatcaacacaatggctaatggataaaggaacattaaaactggtatcgaccatgaaacgatccgatctaatcccatgttagcaactagaaatgacaataggcaattgccccgtaaaaaggctttataagaaatctggggaaaacgataatgaaagtcctgggcaaaagcgactactaaccccatcgccgttgtcatacacgtgattgtcgcaagggttaacaataatacatttccaaaatctcccatataataatgagcaatttgatttaatgttgttcccccattagctgcgattatgaattggtgccgactcgttgtccccaaataaattagtccaatatataaaatcccaattccaaaaatcccgatcattccacccttggtagtagcgagtgaaactgattgttgagatttaaaaccaagttggcgaattgcggtaataatcgtaaccccaaaaaccaatgctgctaatgcatcaacagtattatatccttgaataaaaccattactaaaggcatgattaacatattctggagttggttggggagtagttgtacttcccattggatgaataaaggcgagaagaaaaaccaaaaataacataataaggaaaattggatttaaaaccttaccaattatttcggtgatttttccttcacgcgttgcaaaaaagtaaacaattagaaaaaatgctccggtataggctaataatccccagccttgcatccctttacttaaatatggcgcaactccaatcgtataaggaacagttgccgtacgtggggttgcacataaaggtccaataattatttgaaccaggacaaggaaaataagggcaaaccttttcccatttggtaaagctagttcatataatccatttgcatgtgtaatactaatcgctagtaatgcaaatagcggtaaaagaacaccagaaagcaagaatccacccgttgctgctatccactggttaccggctaattgtcctaaatgcacaggaaaaattaaatttcctgccccaaataacattccaaaaattagcgacccaattaccaagtagggtttacacgctgctttaattgagctcatagttaatcactcattccttttctctcaatttaatgatattcagccggaaatcccgtgactctagtcatgggatggaaggccctatcaagctccgtaaggagctttgttcatttcattgtatttttgatcgtttatatatttctcgacaacttctttactcatattacctaacgtgctcatgtagtaactaggcgaccataaatgaccactccaggattgggactgccgaatttccgggtgtcgacgtaagaaaataaaggcgcttctgcctttgagcgctttgatggcactagtcggtgccttgctaggcggaaagctaattaagacatgaacatggtcaggcataacttccattttctcgattacaatttcgttatcctcggctacttgccataggatctccttcatttcgtttgataactcatcagtagtaaaagttttatgacgatatttagtaacccaaattagatggaaatggaaattatagatatatcgtctggtatatactgcatctttgattttatctttactcattttatttacctctatatttatcatcattgacatatgatataatgtcattatatcaacaaagaaggtgaaattaaatgaagtcaatggcaaaaatgcaatatcattatggcctgaaaatgcgttgctatcctagtgaccaacaaaagcagttgattaaaattaatagtgacgctagtcgctttatctataacgaaatggttgcgatcggtaaggaactaatgcaacttcgcagagttaaattaccgattgacacagttcaggatcgtattaaacaactaactatgcgccaaaacgctaaacaaatgtctaatcactatcaatttttagaagataaacgaattgacagtttggcgaaagctaatgccattcagaactatcggaaagcttggaatgcttttcggaaggtccacaccgctggtgttcctaaatttcatcgaaagagttatcgctggcgttatcaaaccaattgtcaatacccagggcaaaagattgcgttgctaactaacggtacagtctgttttctagataatagccatgtcaaagtccctaaaatcggactgttacgggttgccggttctcaagcacgtcttttgaagagaatgtgtgagactagaattggtactgtgacattgattaaagatccagcggatcacttctttctatcaatgcaactagcttcagatgaatcttttgttaaagtgtcccaagctaatcacggacatatcggaattgatcttaatactgataatttcttaaccgatagtaacggtaatacagttcctaatccacgatattatcgcactattaaaggcaaattagccaaagaacagcgtattttatctagacggcaacggcgtgtcaaaaaagaacatcgttctttacgcgatagtaaaaattaccaaaagcaacgcttgttagttgccaaactccatgccaaagtaatgaaccaaagacataattttctccaacaaatctctactgcattaatcaagaaccacgatttagtagtagctgaggagttgcgtagtaagaacatgctcaagaatcatgctttagcgcttagtatttctgacgttggctggcgttcctttctcggcatgttagcttataaagcagatttgtatggtcgtcaatttattacaatcagcccaagaaatactacccaaacatgtcacaattgtggctttgtgatgggcactaatggcacggacaaactaacgttagctgaccgaaaatggacttgtcctaactgtggtactcaccatattcgtgactggaacgcagctaaaaatattcttgataagggaatagttaaactagcttagtttatctgtccctatggcaacctggggacataaaaggcgttggtaattagacgaccactgtttgattataacttcggttgatcaaataagttgtccctatctacgcaaattgtggtctgaaatccacgaggtttttcggctcacaagccactaactttagtcagtgatggttgactctgacgctaaattataccatgaaataatcatccagacaggagtatattttaagcaaagggagcgactcgtgacttcgtttttcgacgcgaagctagcctctgggtgcccccgcaagcaacaataggcctccaatgttcggttcttttaccgggcgttggaggccattgttgtactgcgccatttgtcttttgtgaaaataacttggcttatgtcacagtccctttaaaactaattttttaaaaagttagctaccagttccaaaatttcttggcgtcgtgagccattaaacatatgtccttcttcaggaattaaatgcaattcactgttaggcatgattacattatatttctttgaagcttccggggaaactacattatcagctaacccatgaattagcagtgtgggtccactataatgctgcgctgtttcgtaaattggtaaaagctgcgccgttcggaagtagtcgccgccaacggtaaagccatgcacatcaaccgtttctggtatatggttagggtcatattggcttccctgacaaactccttttagcgcatcatctttcaaggttgcggcaggtgccagcagtactagttttgtaataatatcgcgataataagccgccagcatcgaagcaactaccccaccttgcgaatgaccaattaggtaaatcttctttgcttgcatagttgtgtgagcatagtcaatgattttcattccatccaggatttcactgaaaactgtcatatccttgaattcaccatcactatggccagtcccatcaaagtcaaagcgtaacgttggaattccttgttggtttaaatagtgcgaaagagcatacagaattttagaatcatcatatcccagattgcccttaaagccatgcatcagaattgcaatcgtatcgtttttaatcgtcgttgttccttcaagaaggccatatagttttagaccatctcgtttgattgttatttccatcaaaccacctctcgcctattatacactgtttgacttagtgttttagtttctccaacatttcccggtggtgagcctcgtgtttttcatccaccttaacaaagaagtaagaaaccgcggctaggatggcgactacaaccccaactgtgatcgttttaattgtgaaattggttaccatgtagcacgagattaagagtgctaacactggaatgatatattttccgggaagcttaaacccgtgattagggaattcattagtatgtttaaacttaattactgctaaaattgatggaacatattgaacaaacgaagcaagcacaatacaagaaacaagaaagaggtaagattgcgtaactaataacattgaaacaacggctgtcaggatgattgctacccagggtgcatcatggcggttctttttaccaacccactttggcaacatcgcgtgttcattcgctagtgaggaaattaatgacggagtgttaaaggaggccgcaaatgccaccccgaaaatactgattaacattcccacaattactaaaatgtatccccatttaccgacaccagttccaaaggcatttgcaattggcgtactatattttgacatcctagttcccaaaataccgattgctaccagcatcattagcgaatacataatcgttacactaaccattacggcaattaatacacgcggaatatttttctccggatcagtcatttgttttgcagcaattggaataaacgaaaagccggtaaacatatagaaaacaacactaaaagctgctccaaaatgtttggcaagcggcatcgccccggtggttgctgcatgaggaattaccggtgaaaaattggcaaaatgaatacaaaaaacgccaattacaataaaagcaagaatcgtaatcatttttgcagctgaagagaggttatcgaccaacttaacaagcgttcggccaaagaaattaataattgagaataataaaattaagccaaaaacagaaacatagtatacccaatgagtattaaaaatcggtaaaaagcttcggagagttgtcaacaaagctaccacttcggcagataaagtacagcatcctagaaaccatgtaaagatgccgagctcatagccagtaaaccggccaaatgcattataggaataaagccatgcggcacccgatccggtaaaccgactagaaaggtccgcataacataatgcaaccatgctaaccgtaatcgccgcacagagtaagacaaggacacttgctaaattcatatccttatagataacttgtggtagcaaaaaagcacctgaaccaataacaccattaatacctaaaaagtaaattgaaataaacgataactttttaggatttttcttttccgtattgataagctccaccttctatcttctataacaaaaataatattaccttcatttaaagtctattcttattttaaagggtttacaagtaaggcaagttaaccaatctttatatttccaaacaaaaagagaccgagttaaactcgatctcttttcttaatttattaagtgtttaattagcaatcagtagctgattacttaagacccttccaagtccagttagtaacttctggtaagtccttaccttctgaacggatgtagtggttgtgcttgttgatcatgttgtccatcttggcaacaaatgcagcactcttttgttcgtaaccaggaacactttggatagcgtccttagctaagtggaaccggtcaagttcgtttaatacacgcatgtcgaatggagtggtgatatcaccattttcttcgtatgagtgaatgtgaacgttacggttagcacgatcgaagaacaatgcttggatcatgtcacggaatccgtgccatgcaaagataactggcttgtcagtagtgaagtaactattgaattcagcatcagttaaaccttcagggttcttgtcagtgttcatcaaacgcataatttcgatgatgttgatgtaacgaatcttcaattcagggaagttgtcatgaagaatgtcaatagctgcaagagcttcttcagtaggttcagtaccagaagatgcaaatacaacatctggttcagtaccttggtcagtagatgcccagtcaatgtagccaagaccattgtcagccaattgagtagcttcatcaatagagaaccattgtgcacgtgggtgcttagaagttacgaagaggttgatgcattcttggttacggaatgccttgttagatacagccattaatgagttagtatctgctggcaagtattccttaacgaggtctggacgttccttttcaaacaagtgagtcaatagacctggatcttggtgagtgtaaccgttgtgatcttgttggaatacagtagaagtatcaacaaagttcaatgctgggtattggtgacgccagtaaagatccttagccttacgtaaccacttcatgtgttgagtaagcattgaatcaacaacacgaccgaatgcttcgtaagttgcgaagaatccgtgacgaccagttaatgtgtaaccttcaaggaatccttcagcttggtgttctgaaagttgtgaatcgatcatacgaccttgtggagccacatcttcgtcgtttggttcgtggacactttccatccattgacgcttttgaccatcaaggaatgcgtaaagacggtttgacttagattcgtcaggaccaaatccacggaagttagttgggttcaattcagccatcttgttgaggtacttaccccattcaagcatgtcttgctttacaacagaaccaggattttgaacatcaatagcaaaatcacggtagtttggcaatacaagtggcttaggatcgataccaccattagtgatagggttcatagccatacgacggttaccttctggtgtgttctcttcaacaagagcaactgggtgaccatcttcgtcaaacaattcttctggcttgtatgacttcaaccaatcaacaaggatgtccttgtgttccatgtcatcttgggatactggaactggaatttggtgtgcacggaatgagttttcaattgggttaccatcaaggtcagtcttaggaccagtccaacccttaggtgcacggaagataatcattggccattgtggtaatgagttatcattgttttcacgagcgttcttttgaatagccttgatttcttcaacaaccttgtccaaagtcttagccatttcttcgtgaacttccatgtgaggcttgtaacccttgaattcaccatcacggtcagcttctttgtaagctgaaacaaagtatggcttccaacccataccttcgaagtacttagtaagttcttcgtcgctcatccatgaaaggatagtagggttagaaatcttgaatccgttaacttggatgattggtaataccgcaccatccttgattgggttaatgaacttgtctgagaaccatgatgccattaatggaccagtttcagcttcaccatcaccgatttcaacagcggcaataacttctgggttatctaagatagcaccaacaccgtgtgaaagtgagtaaccaagttccccaccttcgtggattgaacctggtgtttcaggtgcagcgtgtgatgcagtaccgcctgggaatgagaagtgcttgaataacttagccattcccttagtgtcttgagtatattcaggataaatttcagtgtatgaaccatccaagtatgagttgttaaccataacttggccaccgtgacctgaaccttcgatgtagaacatatcaaggtcatacttcttaattacacggttcaagtgtgcgtaaatgaagttttgaggaacaatagtaccccagtgaccaattggcttaggcttaacatcttctgcctttaatggttggcgaagtaatggatcacccattaagtacaatgtaccaactgaaaggtagttagctgcacgccagtaagcatcaacactttccaagtatttcttggaatcgtaatctactgccatctaataaacactccttctatataaatcaatacgtcctgtgctttctaacaacataacgtaaatcattaaatttacaatgttaatgataaactgttttttcaaaaagtcaacctttttacaaattgatacggtccaattataaaaaattaataattttaagccgctctttagttttgcaaaccggctaacatctttagtctaacaccatttgccacattctacggttatattgcgcaaacttatgacaatctaatgaacttaaattaatattagccttcctggtctaagctaacaaaagtactatatttcatgtatttatagtgaatgcgcatatttgaaacttcaaatggtgttccatcatctaaaaagaagattccatcaattatgcccaccggttctatcgagcttaactttaataattcttggtcttgtttatctgatggtgatacgccaatggtcatgaatgacttggtaactcgttttcccatcttatcctcaagataattaaaaatagagccgttaacaatttcaggagataaggttggtgtaatcttaatcgggataaaaccagtttcaatcataaaaggttggtcatcaattagccgtaaccgtttgatttggtaaacaaagtcattatcattgaggaacaactcttcttgtacatccttatttgcgggaacaacctggtaatcaagcaacttaatcccttgcttcttcccatcagcacggaaactatccgtaactcccaaattactcccctcataatgaaataaggactgattttttaggtagagcggattaataaaagttcctgaaccgcgttttttgaagataattccttcttgcgctaatacacctagtgctcgtttgattgaacttcgacttacctcgtaaatctcacttaagcttcgttcgtccggtagccgcattccggggtattcattgcctaaaattttttgttttatatcacgcatcactgagcgatatactaagtctgccatctaattaactcctcggatttatttaattcgaattttaatgatacactttaagtatagcagacctattttaaattgggatctttttgtaaaatattggtgcgacccagataaatttaggagatgatcttcttatgagtaaaaagaataaaaaaagtaaaatgaaaaaaacgcaggtggaacaaatcttagacaaaaataatattccatatgagcaagctgaatttccgacgcatcaagatggcgatgtccgttcaatgagcgttgaccacaccggcattgatgaacatattatttataaaacccttgttcttactggtaatgtgactggccccttagtcggagtcatccccgttgatactcaccttgatgaaaagaaattagctaaggtttccggcaacaaaaaagttaatatggttccgcttaaaaacttgttaaagacaacggggtatgttcatggtgctaacacgcctgtaggaatctatgaaaaatttcaatatccgatttttattgataatgaagcaaaagaacaaggtgaaatttatgtttcatctgggaaacttggtcgatcggttaaactaaatgctgaagacttagctggattagttcatgcaacttttgctgatttagaacaaaagtagttttccattgattgacctccctagttgtgaagactaaacttattactatagttttatttaaggtcattatagaaaggtcctgaaaaaatgaagaaaaatctatctgcttgtacaaccgttcttgtaggccgtaacgctacaattgatggttcaaccatggcagcacggaacgatgatactttcgctccacttacaccacaacgttttgtaacttatccggcatatcataatcatcctaatcaagttaaagcttatttaaataagtgtgtgattgatcgccccgctgatggttaccgttatcaaggtactcctaatgtcgattacaaaactgaaggggtttttgacgaaagtggttttaatgaaaagaacgttgggatgagcgccacagaaagtgtttatgctaatgcacgggttttagcctgtgatccgcttaatactgaaacaggaattaatgaagaccttatcgtcgccgctacccttcccttcattgatagtgcacgcgagggggttgcttacctcggtaaattaatcgctaaatacggttctgcagaaggaaacggggttattttcagtgacaaagatgatgtttggtatatggaaatcgttactggacatcactgggttgcccaacggattccagatgatgcatacgctgttactggaaatcgaattgccattcaacaagttgattttaatgataaggctaactttatgtggtctgacggaattcaagaatttgttgcaaagaaccacctcaacccagacaagtatgaatggaatttccgccatattttcggaactgctgatatttttgatcaacactacaacactccacgacaatggtacggtcataaggtattaaatccggaaactgaatttgatccgcttgattttgatattccatttattatgcaaacggatcatcgaattacccttgaagacgttgaaaagatcctcagtagccactaccaaggaaccccttacgatccactaggtcatgacggtaccgaccagcaaaagcatatgttccggccaatttcactaaaccggacgcaaaattcccacgttcttcaggttcgtaatgacttaccggaagctgcttcaacgattatgtggatgagctttggtattcctacctttaccccatatgttccattctttggtaatgctgaagatatcgatgtaagctatcgtgaaacaccagagaaacttaatatggatttaaagagtgcttactggatgtatcgggcgctttcaatgattgtcgaatcacaccatgcagaattttctaaggccgacttagattatctcaaagatgcccgcgaatacctctacggctgggtcaatgaagttgctccacaggttaaggggatgtcatcttctgaagtcagtgctttcttaagttcaaagacacatgaaatggttgccgaaatggctaaacgaacaaaagctttaatggctgagttagtaatgaacggactcgaactttctaagttaacattccaaatcgataagaacttgtaaaacaataataaaaaatgggttagtttatggtaaaaaccacaagctagcccatttttctttaattatttccagcaaactgactattataaagattagcgtaaaaaccttttttattcattaatgattcatggttacctgtttcgataatcttcccatgattaaccacgacaatctggtcagccttccgaatcgttgataaacggtgagctacaacaaaactcgtccgttcttgctgcagagcattcatcgcttcttgaatcaagacttctgttcgagtatcaacagaactagtagcttcatccagaattaaaatttccggatcagctaaaaatgcccgtgcaatcgttaataattgtcgctgtccctgtgaaatattagaagcggactcgtctaagaccatttggtaaccatcaggcagttcacgaatgaaagcatccgcccgggccatcttagcagcatgatagacttcttcgtccgatgcattctcattcccatacttaatattttcaaaaatcgtcccagtaaagagccaagtatcttgaagaacaatcgcaatatgcttacgtaaggtatcacgagtcattgaacgagtatctttcccatcaagataaatatggccaccttgcggatcataaaaccgctctaaaagattaataatggtcgttttccctgctccggttgtgccaacaatggcgaccatcttatctcgcggtgctttaaggttaaagtcttgaataagcggttcatcagtatagctaaacttaatatccttgaattcaactttcggaatatcctttccagtaagggatggaatatcctcaaccttatcactcatctctggttcatccaaaacagcaaaaatacgttctgccgaagcaattgtttgttggatggtgttacttaaattcgcaatttgggcaattggttgagaaaactgattggtatattgtagaaatgcttgcacattaccaagagtaatctgaccatgaataacttgaatcgctccaaccactactacaacaaggtacccaagattccgaataaagaccatcattggcatcattaagctagagaaaaattgtgctttccatgctgcttggtagtactgatggttctctttattaaacttttcttcttcatcttgttccttgttaaatgtccgcacgatcgtatgagcagcatatgtttcttctacttggtcattaatttttcccaaagcagcttgctgacgaccaaatagccgttgtgaagttggggcaacaaaagcaactaccagaacactaagcggaattgtgacaagggcaatgattgttaatttccaactaatcgtaagcattaaaatgaaaacaccaacaagcgttaacaaactcgtaatgatttgaatcaaactttgctggagagttcccgcaatattatccatatcattaaccattcgactcataatgtccccattattatgagtatcgtaatatttaattggcacccggcgcatttttccttcaaaatcttgacgcaaattgtaaacaacacgttgcgatactcgtgtcataatttgtaactggaggaaactaaatagtccagagaacaaataaagcaaaatgactgtaattccaatttgccaaatccgggtaaagttaattggaagggtacttaagtgggcaccagctttcatttctgcataccctttaagcattccatcataaatgatcgtagtagcttcaccaagaatttttggtgctaagattgacaaaataacagaaataacagctaagagaattgaaacaataaccccaactcgccatggccgtaaataggcaattaatcgctttgtggttggccaaaagtgttgagcctgttcaggtacttgtggtcctctacgcacgatcaacatcccctttctcgacttgtgacttaattatttgttggtaagtttcattatgtgcttttaattcttggtgagtcccttgaccaactactcgtccttcatcaagcacaataatttggtcagcatcaacaacagtagagattcgctgagccacgataaccgttacggcacgttgaatttgtgggtcttttgctaaggccgcccggagttttgcatcagtttcaaaatccaaagccgagaatgagtcatcaaaaacataaatcgacgctggcttaataattgttcgagcaatcgctaaccgttggcgttgaccaccagaaaaattacttccgttttgctcaacaattgcgtccaatccgccttcttcacggacgaaatctgccgcttgcgcaatttcaagtgcatgccacatttctttatccgttgcttcctcatacccaaattgaaggttagaccgaatagtcccactaaaaaggaccgcttgctgttgagtaatagaaataacctcatgcagattatgctgacttagctttttaactgggacaccatcaactttaatctccccgctttcaatatcaaacaaccgcggaattaagttaaccaaagctgatttacctgaaccggtccctccaataatcgctaaagtctgacctgctgtaactttaaagttcaagtcatgcaaggccaatctttccgccccatggaaacgaaaatcaacattcttaaattcaagtgaggccggttgattaatcgaaatcttttcctgatctttttccggtgcattatgaatactgatcggctgatctagaaccgcattaacccgagtagcagatgccgatgctcgtggaacaaagacaaagatcattgaaagcatcataaagctaatcataatctgagtggcatatgtcataaaggcaattaaatcccctacttgcatactcatattagctacaagatggccacccagtaaaataatggcaacatttgtcatccctaaaataagcgttactactgggaacaacgtcgaaacaattgtaaaggccttgattccggtttgcgtgtagtcctcgtttgcttttttgaaacggttttgttcccgctcttcctgccgaaaagcacggataactcgaacccctgtcagtccttctcggaagattaagttaatgcgatcagtttttttctgaatgctcttgaataacggaaccgcaaagtacataaccaccatgacaataattgctaaaatcggcagactaataaaaaacactttagttagttgtggttctcgaacatacgctagaacacaggctgcaacaagcattacaggtgcttggagcatcatccgaagcatttgcaccatgacattttgaatctgcacaatatcattggttgaccgcgtaattaaagatgaatcgccaaactcatccatttcacgattcgagaaacgtaaaaccttatgatagatctggcttcgtagcttttcacccaccttcattgattgggtcgccgcaaaataaacatttaatcctgctgccactaatccaatcgcagccacaatcagcatcttaattccttcattccaaattacgcccatattcttttgcacaattccccgattaacaaggtcggcggtaactgtcggcaagtataggtcgcacgaaacttggattaataaaaagaaaactgcaccaattgttgcccataaggctaaattttttcgtgctatacgtatcaaaacaatccttccttcatctatttttagtcatcttgaactattatacagactttttaaaaaattagcttttattctgataatccctttgattaacacttttgtataagatagaatattatttgaaagcaattacacacttttggcacatacagaaagaagatagatatttatggttaaaaaaatttttgcttttagtatccgaaaagatgaagaaccttacgttaaagaatgggctaaggatcatcccgaagtagaagtagaatatacggatgaactcttaactcctgaaactgccgcaaaagctaaaggagctgacggggtagtcgtttaccaacaactcgattacacaccagaaacgctacaagcactggctgacgaaggtattacaaagatgtcactacgtaatgttggtgttgataacattgatatggctaaggcaaaagaacttggctttgaaattaccaatgttcctgtttactcaccaaacgcaattgccgaacatgctgctattcaaacagcccgaattcttcgccaaaccaaggtcttagatgaaaagattgctaatggcgatttacggtgggccccaacaattggtcgagaagtgcgtgatcaaactgttggtgttatcggaactggtcatatcggacgtgtttatatgcaaattatggaaggcttcggtgctaaggtaattgcatatgacccatttgaaaatccagaattaaagaagcaaggatattacgttgacagccttgatgatctatatgctcaagccgatgtggtttctcttcacgttccggctaccaaagagaacttccatatgattgataaagacgcaattgctaaaatgaaagacaatgttgtaattgttaactgttcacgaggcgcattagttgatactgatgctgtaatcgaaggacttgatagcggaaagatctttggctttatcatggacacttacgaagatgaagttggaatctttaatgaagattggcgtgacaaggagttccctgacaagcgacttaaagaccttatcgatcgttcaaacgtccttgttactccacatacagctttctatactactcatgctgtccgcaacatggttcttaatgcctttgacaataaccttaaattaattaatggtgaagaagctgacacaccggttaaagttggctaatataatcactacaaatgaaaaaagagattggatgaatttccagtctcttttttatttagtactattgcaagtagcgtttaaacgcaaccgttaagggtttatacaagataaaataacaaccaaaattaccaactgcatgatagaaatcaaatagcaagccacttagccagtacgccataaaagcagcccagcccccatatatcgacattcctaaactaactatgaacccgtattcaaaacctaaaaacgtcgctaaaattaactgaagagtgaaatgcttctttaagggtgttactttagctaatcctgctactgtaacaacacaaactatatatgctaaaatttgtgggattgtccatatgccaaatcctagtaagagatttgatagaaccattatcattactgctaacgatattccaaaaccaattcccaacattaaagttgcaatcataattagatcagtaactggctgtacattaggaattggaataatcttgaatacacgtaaaacagttcctaaagcagcaagcatggcaattaatgtcatccgtttaacttgatcatgcttactaacaacctgcgatcgcgctttcatattattccgccttatctagtgtaaattgtaccttatcattattcttaagagtttgctgattagctaacttatttacttttttaccatttactgtgtatgtccaataaatactcttcttttggttttcttttctaccatcaattgaagtaataaaaccttttgcttcctcaactttccaattcttttttagtccagtaattactttatcgttcttctttaaagtagtattccttgtggcaacagtcttcttaccttgtttaagagtataggtaacttttattgtattattattccccttttgatctttatttgtatatccagttagcataaaaaatgccaaaaacatagctaagatactgctcaaaactttaaactttttcataaattattgcctcctgcgccttttttgaaagcgctatagtttttttacaacttaaaagtacaattacttaggagacagttcaatagtttattaaaaagcagacaaataaattctacttttttcatgattaattaaaaaagtagaattttatcctgagtttttttagtttttcgtcaacattagcacttttatgtttataaaataacaagatttgattttttaactaattaggctttgtcgaagcaatcataataataatattttgttcttttagtatttttttggagtttacggaatgaaattgaagtccatctcctgcaatgtattcatatttgtgagcattgccttcactccatcaagccatggtaagagcatcatggccccactcccttcacccacacacatattaatatcaatataaggatcaagaccgagagcatcaagaacaattcgagatcctttttcctttgatttatgggtagggatcatataatttactactcctggcttgattgaattcgctagtaatgctgctgaataagataagaatccatcaagaagaacaggtttattcattgctccagctgaaagcattgctccagccattgcacctaattcgagtgcaccaacctcacttaatactataagcggatccggtgattcgttttctttcaagtttgctcgttcaaggcttctattaacaacatcaatcttatgttttaaacgttcatcagaaatattagacccccgcccaacaacttctgctgctgttttattcaaaagtgctgcaattattgctgaagcagcagtggtatttcccatccctagttcgcctgttgcaattacctgattaccttcttcaaatgcttttactcccatatcgaaaccatattgtacagcttctctcgcttctgctatcgacattgctggtttatgtagcatatcttcagtttcatgacggattttatgaaccctgaccaaaggaaaattcaaatctgttttaattccaatatcataaacttgtaagtcacaattaaaagcttttgctagtgctgcaacggtagtatgtcccttcatcatgttaactgcttgaattgctgtaattttttgcggactagcagaaaccccttcatgaacaactccattatcagctgcaaaaactaagcattttcgtggtgtaatattaaaatcagttgttcgataaattcctgctaaatgatcagcaagttcttctaagcggccaagcccttttaccggtttagcaagatcatctattttctgctgcattgcgttcattttctcttcattaagtggtcgcaactctacttcatcaaattccattttaattttccctctcataatgccataagctatctaaaacattttcaagtacgtgctttttcctatcgggatatataactttcaatcccttttcttggatataattaccggtattctctcctaagacatagtaattaatatcacgatactcattactatctactctcgtcataactccaaacatacgattaaagttcgaaatactagtaactaatgcacttgtaatatgttgtttcataaaaattttaagtgcttttccttcatgctgtttatcccatgtatttttataaattacaatttttcgtccataaaaatcggaatagtatttctctgctttatctccaataagccaacaaacatccgtaacatgtttattctttaattcctctaataatgatttccggttctcacttggagcaacttgaattggattactaaccttattttccaaattttgctgaatttttttgctaagaacataaatagttgctgttgaatttagtttctttaactgattgcaaaatacctgcgcaccaaaaagactagtgattgttagggccttactattttgtaaaatctctttatcttcttgcgttaaattaaccgctttcaaaattcggaatggaaaatagatcacatcgtctttttgttctaactttattcgccaatatactggaactttatttttaggataagtaatcaaaattgccattttattatcctcctcatgtttctacaaatatcttttttattgattaagataccaattctgaacaataccattttttagattaataacgctgtaacaagatgccggaaagttaagcgaataaaagtccgccgttggatcaaccaattcttgataaataattctaatagagcctagatgagcgacaacaaaaacaacatcattttccattgtatgatctaataaccatcgtaaaccgtaatttacccgctctttaaaatcactaaatgcttctattgtaggaggggtataggttaatggagctgctaaccacttttcccattcatctggataacgattctctatctcattcgcatctaatccttcccagcatccaaatcctttttcggcaaaatccggtaatacgattgtgggaaccgttggacgctgttcttttaatgggactaatgtttggactgttcgttttaagttagtcacgacaaatagtgttggatataacttatttacttttgttgctaataattttgcttgttcttttcctttttcatcaatttccacattggcagtgccataaaattttcgcaaacgattaaattctgtttcaccatgacgagctaaaattaatttcataatccccacctcgtcaatattgtaaggacaaacaaaaagattaacggtgataaacttgcaaacgcacctaaagtatcccctggcgttccccctaatactttcgtgacctttcgtcgataagaaattgctattattggaattgccagatagcttattaatccctgccaagagaaacataaacctattattataatggaaaaaatttgtgcaacaataattcgccatgtgcttattcctagccaaatattcgaaagcccatgtttattttcgggataaaccattttataaaataataaagacaaaccagttttagttaacattgttaaacaaacggtcaataaaatcatgtgaaataaatcaaaatacgaactaataatgattcctagtccgattactaatccataataatatagtaatgcaaggctccccattgtcccaagtctactatctttcatgattgcataaattttatctgatgttcgtgatgaaaagaatccatctgcggtatccgccagtgcatctaaatgaaatccgcccgttaataagccatcagtaatccagtaaagaatccatgcaaaccatatcggaaataagtatgtaaatccccaaaaaactaccccttcgatacaccctaataaaaagctaaataatgtaatgtattgaatactagttttaactttattagtagcatcatcaactgaaattggaatatttaacttggtaaaaaattgaccaaataaaatcaatgaatctaacataacttcacctactttaacttctgcgcaattccactaataacaaaataaacattatcggcttctttagcgattaattgattaacttctccataaagatcccgtaatatacgtgtctgctttgtagccggtactactcctaacccaacttcatcactaacaatcaccattgattgattgtttactcgaacagcagctaagatctttttccaattactaagtattttttcccgtactgtcgctatttcttgtgaagaagcactttctaaataatcatcgattttttccggcgatgtttttgctaaaactaagtcataaaaaagattagtaactaacataatggcatcatcaagtaagtaaccatcttgttgactattattaataagttcatcgacgtgctgatactgctcgcgagttatccatttatttgaacgtcgagcttggtgacgctgaattcgaagttgcatttcgccatcgggattttttactactccggtcgcaatataacagatccgttctttccgtgaatacaagtgctctgcaaattcggatttaccactttttgcccctcctaaaacaaaggttaaactgctgttattcatttttaataatcctttcaaaaagggctgtgacaaccattgccacagccctttaaatattctatttacttggttgccgcattaaatgctgcatcaaatgctgcaattgtcttttcaatgtcctcatcggtgtgtttagttgagataaagttagtttcaaattgcgatggcgctacatatacaccatgagctaataattcccagaaacacttttcaaataacttctgatcacaagctttaacatcatcaaaattattaattggatcactgttataaaagtaactccacattgtaccaacatggtgcactgtcattggtacaccatattggtcagctgcatgtttaatgccttctgttaaagcagtaacttttttatccatttcaacataatcatctggtgttaattgttctaaggtgctaattccaccagtcattgctaacggattacctgacaacgttccggcatgataaatatctccagcaggcgtaatattttccataatttcacgacgtccaccaaaagcaccaactgggagtccaccaccgattactttgcctaaagtggttaagtccggcgtgatattgactagactttgaacaccatgataagctgccctgaaccctgacataacctcatcaaagatcaataatgcaccatgttcattggtaacgttacgtaaagtttgtaagaactcttgggttcccggaataactcccatattgccggcaaccggttcaacaatcgcacaggcaatttcatcaccatgttcagcgaaaagtttcttaacaccagcaacatcattataggcaacggtaagtgtatcataagccagatcatcgggaacaccaggcgaagtattaattccaaacgttgctaatcctgagccagcatcaactagcaatgaatcgctatgaccatgatagttacccacaaatttaacgattttttttcgatgagtatatccacgtgctaatctgatcgcactcattgttgcttcagttccagatgaaaccattcgaatcatttcaattgacggcataatcttattaacaatttttgccaattcagtttcttgaagggttggcgcaccgtagcttgttcccttagcaactgctttatctaactctgcaactacatgatcatctgcatgtcctaaaattagtggcccccatgaaagaacataatcaatgtacttattgccatcaatgtcataaatatattcgtccttaccatggtcaatgaataaaggatcaccaccaacatttttaaatgctctgacagggctattgaccccacctggcatatacttttgtgcttccttaaaagctatctttgactttgttgtatctaatttactcaaaacaaacccacctaacaaattaaagtttcttagcaacgtccttggcaaagtaagtaataattaagtctgctccagctcgtttcattccaaccagactttcgtaaacaatttggttttcattaatccaaccattagccgcagctgctttaatcattgcatattcaccagaaacattatatgcaactaacggcagcaaagtatgattacgaacttcacgcataatatccaagaaggccattgctggtttaaccatcacaaaatcagcaccttccttttcatcactagctacttcgcgcaatgcttctaagcgattagctggatccatttgatatgttttacgatctttaggcccttctttaggcgaaccatcagcagcatcacggaatgggccgtaaaatgatgaggcaaatttcacagcataggacataatcggtgtatttttataccctgcttcatcaagtccttggcgaattgctgcaacatacccatccatcgcattagacggtgcaattatgtcagctccagcttttacttgacttacagctgtctttgttaagtattttaatgattcatcattcaaaacgaccccatctttaagaattccacagtgaccagtacttgtatattcacataaacaagtatcagcgataacaattaaatctggataatttttcttaatcaaacgaattgcctgttgaacaattccattatcttcccatgcgccagttccaacttcatcttttctttctggaacaccgaaaataataattgatttaattcctaacttcacaatttctgtaatttcatcaagaattgaatctaaactgtaacggtaaatgcctggcattgatggaatttcttctcgcccattaatagtggcatccacaaagaccggcataattagatcatccttattgagatgagtctctcttactaaatcacgcatggcagtgctagtacgtaaacgacgatgacgatcaaattgcaacattatccctattctccttcaataattccaaatttatccttagccaataactgatcagcaacttttttaccgactccagaattattggcaggtatttttgtttcttttataacatgttcaccattaggggaagcgatcaacccatcaaatagaatttgaccatttttcgcgtaggcatggcccccaatcgggaaattacaacttccacccaattcacgcataaattcacgctcaacttgcacacaataagctgattcttcatcattaatttgatcaagcattttgcgaattctagtgtcattttttcggcattcaatcgctaagcagccttgaccaactgccggcataatataattttgcaaatccaaaacatgataactacttaagtcaatatttaatcttgttaatccagcctcagctaaaataataccgtcaagcgcttctgtgtctatttttcttaacctagtatctatattacccctaataggtataatttttaagtctggtcgaatacttaatagttgtccctggcgacgtaaactatttgtcccgattcgtgcacctttaggaaggtcattcaacgatgaaagatttttccggctgactaaacaatcatatggagatactcgtttaggaaatgctcctaaaactaattcttctggaagaatcggcatcacatcttttagactatgaacagcaaaatcaatcgtgccatcttttagttcgtcttcaatctctttaacgaaaacgcctttcccaccgattttagcaaggctgacatgtcggtttcgatccccttcagtaataacgttttttatttcaaattttatgtcggggaaaatcttttccaaactagcgattaccaattctgtttgcgccattgctagtttacttttccgactgccaacaattactttatttgtcattattttgattctctactttcaaattatccatgccaaaaattttacagaaaaagtcaatatcagccgtagcccctggtgttactgacaattctttaatttctttaattggtcctttaatcatttgattaacaatacttttcatatgcttactaattacttttcgttcatgcgaatctaattcaggaagcttgcgaagtaaactatcgtaagcttctccttcaatcctcaacgaatgctcacgtaatcctctaattaccggaacaatatgcagttgcttttcccaaatataaaagtcattaacttcttggggaatttcattagcaattttttgaatcattaatcgtcgtttttcatcattggagtttaaaatcatatgaacatgatcaacatcataatattttaattttgtactgttaactgctacatttcgtggcacaccaagatcaacaatcattgtgcttatctgttcatcggccttaaataagggttgcttaactgtagctgcaaaaatagctgcatcaacattatgtacgactgttgcaagctggttaaatggacgggcctcaactactccttgaagttctgtcgcaatctgctcagccttgctatctgttctattaagcaacagcaccttgctaaagcccatattgcttgcattataagcagtatgttttccaatctgtcccaacccaacgactgctaaggttttaccctcaagtgaaccaaactgcatcttaatttggtgtagaccagcttgacctgatgattgtgctaattcactaacacggtattttgtatgcattcttttagaaaatgtaattgcttggcgaaataaatgatttaagattgcgccagttgttccctcttttgttgcaatttgaaaagcatccttcatttgacctagtatttgcggctctcccttaattaacgagtccaggccagtgatcaccttaaacaaatgctcagcaacagcgtcctttgtcgtaacagtaacaaattttgtaaaatcatcaattgtataatggaaccattccgctaaaaatcgtcgaatatagtaacgacctgtatgtatttggtccacaaccgcatacacctctgttcgattacacgttgaaattaataaattttccaagatactcttttcatcatttaataacttatctgccttcggaacttcttcttttgtaaaagaaaatttttctcgcaaatctaatggtaattgatgataatttaagcttacacacatcaaatacattttattcaaactccttatgaaacttttgctttatccattctttaatctcatttttcattttcttagccatacttggagactttcccattgttgagacactaataaacatgtcattagccttaatcgttgctagattataaaagtctgaattagttttatcactggtattgttcaccagctgaaaatgtgtcgcctctttttttacttgatcattaactgctctatcatcagtacatgtaataataatatccatattttcgacatatttccgctgatacttatctggtatccaattaatttgggtaggttgtatttcaggggatagaagaggactaataacagttgggcgaacaccagctgccaataacttatttattttacgacatgcaacttttcctccgccgacgacagctacatttttatcagctaagtttaagataatcggatatggcgattgcataatttattcatcctttattctttcgttgagtcttgcaagatttgattaaacttatccatgtcaacattctgagcaaatagttgggctaatttctcatattgttggtctttataaccactaatcgaaacagtagtatctaccaatggtgccattccctttgctacgcgaagctgatttaacaagtgtcgtgtccaataagggttatcaaagattccgtgaagataggtaccaatcactgttccatcagtactaactgctccatcctcacgattttctggttgaccgtttgtttcctggattgttgagaatggtgttgagtttagaccacgttttgttgttcccatatggatttcataaccttttaaaatgtaattatttcgcttggcaaccgcctgagttgttgtctttttttcattaaaggttgtttctgtatcaagtaacccgagacctttttgttctttaattggtgactcaatccctgttggatcatacagcatctgtcctaaaatctgatatcccccacaaataccaacgatcatacttccgtccttatgagcacgtaagattccctctgcaatcccatttttacgcaaagctactaaatctgcgttcgtgtttttacttcctggaataattaataagtctggagttccaagttcctctgccgttaaaacatatcttaccgaaacatctggttgaatttccaaactatgaatatctgtaaagttagaaatcttatcaagatcaattaccgctacatccaggtctttttgcgtatctttttgtcgtggtttccgaattagcgatacgctatcttcttcatcaatatcaatactgctcattggcaaaacaccaatcacaggaattcctgttagtttctcaatcatcttgttcccagattctagtaaggacttatctcctcgaaatttattaataattattcctttaatgcgttgctggtcttcgcgaggcattaatttaatcgtgccataaattgaagcaaagacaccgcccttatcaatgtctgcaactaggattactggtgcatcagccattcgcgccatccccatattaacaatgtcattttcatttaaattgatttctgcgggacttccagctccctctaagactattacatcattttcatctgctaatgtattataggccatcataatttgtggaattagttctcgcttgaattgataataactaacagcatccatattcttcagcacttttcccattacaataacctgagaatctttgtccgtggatggctttaataaaattggattcattcggacatctggtttaaccttagctgcttcagcttgaaaaacctgcgcccgacccatttcatcccctttctcagtaataaatgagttcaaggccatgttttgcgacttaaatggcgcaaccttttgaccacgattagccaaaattcgacaaactgctgcggccaaccagctttttccagcgtcagatgccgttccttgaaacattattgactgcactgtcatgacatttcatcccctaagcttaatctatgtaccaaaagctgttttaaaagttcagcctttgagtttttatatgtttacttaccttgttcggcaaataattcctgttccgttgtatataaaggcaatcctaatttttggtgaatcttaactagccacggttgttccaggttattttcctttaataactgttcatcattaaaaacgttttccctatttccctctttaagaatccgattatttcccaaaaggtaaaaatagtcacatacttcatacataaagtccatatcatgactagagagaataattttttgaccattggcaattaacttctttatcaattttttcattcttaacctaccatctgggtccaaaccagaagttggttcatcaagtaagatccattcagagccaatcaccataatacccgcaatggcaacccgttttttctgaccaccactaaggtattgaataggttgatcctttaagtttgaaatatctaattcacgtaaaaccctttcgacacgttgcttaatttcatcattagaaacttttaaatttctcaaagcaaacgcaacgtcatctttcactattgagtagaagatttgctgatcagaattttggaaaacaattcctatttttcgccgtaaatttcgaagtccttttttagaatattcaactttgtgaccatcaacaaaaatctcacctgctgttggttttaattcaccaaccaaattcaagaaaagcgttgatttccctgcaccattatgaccgataatgccaataactgattgattatcgtgaccgagcttcattgaaacatcgtccaatattttatgcttatcgtcatagctaaagcttacatgcctcaattcaatcattattgctcctcctaaagataaaaatcaccattatatagcttagcatcgagtgctttagtcatcatttgataatttataatgacttgttcaaataacatttttgctaaaattccagatgaatgaatcattaaactaaaagagtcatagccgaaccgtaatcgttgagcacggtgaatctgctcaaaagcatcaataaagataaagatgaaacgatacattagcatcgttacttcaatcattactcgtggcagatgcatagcttttagtacctgtaaaatttgaataaatggggttgttaacgcaaaccagtacgtacagacaattgctgtcatacattgcaatgctacctgcccagctttaggcatcattacttttgccaatccaagataaacatttccaagttttatcggtccaataagggtagagcgttgagaagaaatagttacaacaattccaatgatacttaaaactacaaaaggaataattgcataaaaccaactaatataacgcttaaatgaaacattagttacgtaaatggtgatacctgctactgtaaataggacaattactttaatccattgaattggctggaaagctaaaaccattcctactaaccataaaaaagcttttaactttggcgaccaattaacaattcgattttcataagcatatttatcgatactcaacattaataagtcaccagcctttactattgttttacagtctgtttggttttattttgttgagctttctttttaccatgagcagccccaataaaataacaaataattcctgtccccagtgaaccttgcacagtaaacaataaactttcgatttctcccgatggtggagtccagacaggatgcgcccatgctttataacttggatcaaatttctttatttgctctgttccttggtcatcactcccgctatattctcctttaacaaaaataaaaggaatcaataccaaaagaattacacaaattgctaggataatattagtttttgttcgttttttcattgtagggctgactccttccataaatcgttactgattaccaagttataaacaataaccgtaagcaatccttctgctattgccaatggaatttgagtaatagcgtaaatacttaggaatttgattagcgctgctgcaactccaccattcggatcagggaaaacaattgctaattgaaaagcggtagttacatacgtagaccagtcagcaaacatcgcacacaaaaatagtgaaactgaacgactaactttcattgctcgacataatttccaaactgcataaccaacaattgggccaacaattgtcattgaaaattcattagcaccaagcgttgttattcctccgtgtgctaataataatgcttggaacaatagcacaataacaccaagaaccgacattactccagggccaaacaaaactgttcctagaccaactccagtagggtgcgaacaagaaccagttactgaaggcaatttcaatgaagataaaacaaagacaaacgcaccacaaagggccaacattaccttggcattaggaacaccagaatttacaatcttatacattcgataaagaccataaatgaagaacggaagtgacactgcataccagaaaatacaccagcgtggcggaagcattccttccataatatgcattgcatgagctgtggcaggataagcaagggtataaactagtccaatcataaggaaagtaataaacttacgatattttttaattacttttaacatttttgtttcccttctttaataaagccgtagaaaaataaggcagtttgtcattaattgaataatcaattaatcgttgcttcttttgtttttccattgaagcattttcaacaacaatcgttttactcaataagtctcgctgttccaatatcttataaacctgagcaaacctagtagcaattttcataattaccacattatcattaaggtcgattgctttttccaattgtgtaatatcagcagtcgctggaataatttcaagactttcttcatctaacattaggggaacagagaggctggctgcaatttgactgaatgatgagatccccgcaatcgtctggatatcaatccgttctgctaacattttcgcaatataactaaaagtgctataaacagatggatcaccaagggtcaaaaaaccaacattattatcatttttaacatctttagcaatctcttcagcaatttcttgccagctttttatcttcttttcccaatcattaatcattggaaaatgtcgtcgctttatttttaaattcgctggtaaatacggtgcagcgatattttcagctacacttctaccacctttatgagcttggggagcatataaaatatcaagcttttttattgtattaactgcttttatcgttaaaagttcactatctccggggccaactccaatcccataaaaactagccattttaatcaccttcttcgacaaccggctttagctttgcaataaacatattttgaatttctggaaattcgcctaatcccttcaatacaggatgggcggctatcccattctcctttaagatacttttccatgatttgggatcatctgaggccatatcattatgcgcatggtttcctgcaaccatcattaatggctgcaaataaaccttattaatatgtgcatgacgaagacgcttaatttcgtcattaatatctggataactttctaccgcacctacataactttttgaaccatataacatatgatccaagcaagcataagttgtaaaagcactatgcgctgttccgtggcccatccataaaacggctttcccagatggtaaatattcactttgcttctgtaggaatacaactaagtgttgaaaatcttcaaacgtctctaataaaggcgctgttactttaattttcaaaaatttttctttataacgattaaccgcatcacatactaagttatattcaattcctggaataacatgtaaagattggacatatacttttgtgtatccctgatcacgtaattttgacagtgctgtatcgacatcatcaattcgaattccttcatttttttcaattcgttgccgaacgattctagatgtaaatgccctaaagacgtcataatctggaaacgcagccccaatcgctttttctgtagctccgattgttttttgtcgtgtttctggaaatgttgttccaaaacttactgccaaaattgcctttttagtcatgcataaattcctccttgacctgaataacagtcttctttacgtctggtggacatataaccacatgaccaaagccagcttgaattgcagcttgttgaacttttttccccattgcaaatgcttttaacattgatacttgtgatagctgtttttcgcttaatgaagctaaaaaatcatttatactagcagtacttggaaaaatgacagcactgaattctttaaggtcaaacggtaatacaagcgaccgtttcttcttttcatataagctaagaaaagttccaatattatatgttggtttactgccaccaatttcaatggttcttttcactggtatatcttgcggcatgccttttattgctaagattcctgttttctgtaatgcttgaactactcgatggttactggcaataatttttttatctataagttgtcgaacatcaataccattctttattaagagggtaataaattgatgataagcaaggacatcatccacaataatcgcatcgtattcatcgatagaaggaagagtcacttctaatggctcgattaaagcacgctggtaaaagtcagcagttgcccctaaatcttctaatgaattaaaaaggcgttgatgttcactaaaaggaattaataaatgcacaccggtcaatggtttattgatatttaattgcttactcaatttaacgacttgacctacaacaattaatgctggcgatgaaagttgatgtcgagcaaccaattcattgatattttccaaatcgccaataaccatcttttgtcgccattgggtagcccactgtattattgctacaggtgtttgcgatgattttccatgctcgactagctgttgacaaattttaggaagttgcgccattcccatcaaaaaaacgattgtcccttcttgatgagcaatattttcccagtccagttgctgaccattctttttatgatgaccagtgataatatgaaagcttgaagcatagtcacggtgagttatgggaatccccgctgcagctagcccagcaattgcactagtaatccctggaataacttcaaaattaacaccaaactgttgtaatacctgtgcctcttcaccaccccggccaaagacataaggatcaccagcttttagtcgaacgacctttttcccttgcttagcgtaatcaactaacatttcattgattttcgactgcttaaccttatgatgtagaggtaatttcccaacatcgatcaattccgcctcattatttgtaaatgctaataacgaaggatcaattaaccgatcatacaagacgatatccgcttcatttaatcgccgcttgccaattaacgttaataattctggattacccggtccggcacctagaagtgttactctaccattcatcgttttcctccaagtatttctccaattcctgtaaactcgaaaccatatgtggatagcttatttgtggtcgacgaataattatgcagggaattcctaattgctgacaagcagctatcttttcttgaaccccaccttggcgaccactctcttttgtcaccacaatttttgcattggcatgtttgaataattctatatttaaggccagtgaaaacggaccttgaatggcatcaatttgtgaagcgacgaaaccagcattagttagtttttccattactttagttgtcggtaaaacacggacatgcaaacgatcagcccctaactgctcagcataggtaggagcagttttactaccagttgacaaatatatttttccttttaccttctttgatatctgacaagcttcttctaatgaattaaccagtttaagatttgcgtctttaatgtaattatttgggcgttcaaatcttaaatatggaatcttaagtttttgggcttcgttgattgctaactctgaaattacccgagcaaagggatgggttgcgtctaaaataagtttgatatggtggccttgacagaatgaggggaaattttcagtagtgaaggtaattttaacaacgttttccgtatgcttagccgctaacttaactccatagtcgctaatgactgaaataataaatggaacctttgcatcccttaatacatctgctacttccaagctttcagttgttccacccaataataaaatcatagtgtataacctcgtggagtaatcatccgcccatcttcaacataagtattcttgttacctacaattacaattgaagtcatattaatttctgtttcatcaagatcagcaatcgttgttaccttatcaacttcttttggtcgtgcaacatctttcccaattccgacaattgtatctggtgacttatatttcaatataatatcaagggcttttcttaagtgatgcgggcgacccttactccgtggattataaaggcaaattacaaaatctgctttagctgcagcatcaacacgttcggtaataacttcccatggtgtcatcaagtcacttaaactaatatgacaaaaatcattcattaacggcgcacctaaatgagcagcagctgcaatacttgctgtaacgcctggaattaccttaatatcaatatgttgctccattttaccggcaagctctaaaatcaaaccagccatcccatagatcccagcatcaccgctagaaataattgcaacatctttcccagttgccgcaatctcaagggcttttttacaacgttcaatctcgccccgcattccggtaacaacaagttctttcccctcaatcatatcttcaattagccgaacatacgttgcataaccgacaattatatgcgtattttcaattacctctcgtgcttcttcagtcattaatttttttgatccaggtcctaatccaactacatataacattttcaattcctcctaaacttcatgcaagcgactaagcgccagtgtgatttcatgatctgcataccgctgtgttacattccgttccccactagcataatcagcagcagcacatgcaacattaccaactcctaccgtcttttttacaaaagcagattctggataattttgactagcttcttgtaactctgcagctggataaaattcagctttaatccctaaggtggttgctaaatattgaattgctccttcatgccttttaatatcaattgatgctactttaataaatgatttccacaacaattgatgttgttggcaaaattctgtaaaggcttgttgcaccattgcaattgtaatattttttcggcaaccaattcccaagacatttacccggggaactacatgaatcacatcagaacttttagaaaaaccagtgtgatctgaaacaataattaatggtactcccgattcatgatctttaatcctagttaataccttaaatccactaaactggttaatgtattgtgttaagtacggctcaataaagagttctacaacttttccttctgctaagcgacgattgattgcttttgtattttctttaaagttgggataccatccattgacctttttagctaaaacatccaatgattgaacattttctgtgtcagttgcggttgtaattactggttctgatctcattaatctagcaattaaccttgtccattcattagctccaccgacatgcccagaaagtaaactaataacatgccgtgctttttcgtccattacaacaactgctggatcaactgttttatcaataatcacatcagccaatgcacgaacgacaattcctgttgccataatgcaaacgatacaatcatattttttaaaaagatggtggattgttgcggtaaaagcacctcgtgaataataattttcatcatctcgagctaagcgttggggtaaaacaaggtctaccttatatccttgtttttttacccggcttttcaaacttcttgccgtcgaagcaccaccctgggttaaagcaatcacagcaaggcttttcataattacttactctttttccggaacattgtactgaaacttgcatcatataaatgagaataattatattcatcacctaagaacttaccaaccataatcaatgctgttcgtcgaatatcggcatcatgcactttttcagcgatatcacttaatgttcccctaacgaccttttcatctggccaggttgccttataaataacggctgctggtgtgtcttcagggtatcctccctcttctaattgcgaaacaactttcttaatgccttgaacagacaagaaaattaccattgaagtttgatgttgtgctaacgattttaaggattccttctctggcacaggtgtccgtcctgccatacgcgtaataattacactctgcgctacttcgggaaccgtatattccacgcccatgcttgacgccgcaccaaggaatgaactaacaccaggaacgcattgatactcaatatcccgttttttcatttcttcaatttgctcacgaatcgaaccataaattgagaagtcaccagtttgtaatcgtacaactgacttcccctcttttactgcttcttccattcggtccacaatatcgtctagtgtcattttggcactatcatatttttcagcatctgctttacagtaattcaataggtccttattaattaacgatccagcatagattacaacatcagctgctgccaataacttgtatccctttaacgtaataagatctgtttcacccggaccagctcctacaaaactaacaattgccataattaatcaatcctttctattttttagcattaacaataattgttggattgtttggtttaaagaaatgtcctttccctaattggtgccaacgcaatacaccaacctcaaccatttcaatttccttgaagccagctgatgttaataacttttcgacttgcattgcgttttcaaacaaaataaagttcaggactattgttccgttaacatttaaatgtgtactagcaaacttaacgattccatctaattgcgctccactaccaccaacaaaaattgcatcatatttctgattaggaatatcttggggagcgattcccttgattaagttgatattatgtaagttaaacttattaatattttgtttgataatatcaatcccggcattgttcatttcaatcgctgttacatttaagtttggaaactcgcgagctgcttgaatactgatactacctgttccagccccaatatcaaggaaggtattcttatcattaagttccaatttatcaatactgattgctcgaacttctgattttgtcatcggaaccttatttcttaaaaattcatcatcacgcatttgtaataatcaccacattcatttcatatcttcgttgctcaatcgttgtttcatcgtattgcgttattttttcatctggatagcttagccgttctccaacataaattttgcggtgcaatccccgctttttaatctcttgcccaatttcaaatggtcctagttgctggtcagtaaccatgccgactttagaatgttgtaataagaaatcgaaatcaggggttcgcccatgactacttgtcaaatagcaatcattcattgacaattccaactggtggaacatgtactgaatagaactaattccaggaataatttttattttttgattatggatgttagcagttatccaagttccaattccatacaacagtgggtctcccgatgctaataacacattattttgttctggatgttcttcaaaataagtcttcaaggccgctaaccgtggtaaggccatttttttactagcaggaactgcaggaattgtcattaattgccgttttgaaccaatcacaatatcggctttagacaaatattttgtcatcccctgcaaacgataattttcattaccaggaccaattcctaataccactatcattgccactcatccttaatctcttgtactggtttacttgccgctaaaaaaccactttctcgtgaaaaaatcactgcatcaatctcaatatgtggttctcgatgtgctaaaagtttttctgtccgctttttaattttgtcaacaataatttggtaaacatcctgatagccagcttgattaataagcttaatcatagaaatagtagttaagcagttattaattttttgcaaaaattcagtcggcacgccacccattaacgcaagatttgcaaccataatctctgctcgtgcatcagcatctttgctatgagttgagaaaattcctgcagcaactttgatcattttgccaagatcaccaacgattaaaactttattgaactttaatcgttgtgtttcatggagaacataaccaacaaagttactcatttggacaatcttgtcatcagcaattcctagctcatctttagcaaaatcttctccataatttcccggtactaaaacaattgctttatcgccccgtttacgatgaatattcatttcaattgaaattgaatgtttccaacttgattcagacattggagtaacgaccccactggttcctagaatggaaattccaccaacaattccaagtcgcgggttgtaggttaatttggctattttttcgccttctggtacagaaataacaatatttgcaccaagattagatcctagctcttttcgtgccgcttctttaatcactcgccgcggtgtagggttaatcgctggtatccctggcttattcgctaatccttctttagttacgcgcccaactccttttccaccatctaaatgaatttcatcatcagaacgtaaactaactttggcaaagatgagtgctccatctgttgcatcttgatcatcaccaccatctttttttatggcgcaactggctgcatttttatcaaagtcagtttgctcaacatcaaagattgcaatctttccattggcagcatgaacagtaaccgtttcttgtggttcctgattcagcaaagtcctaatagcagctacagttgccgcggtagcagtagtgccagttgtaaaaccctttcgtaattttcgcccattgtaataaacaaaattatcctcagagttattatttggtgtgacggccatactcatcacctaaattcttaatatccatgttatacatcactgcattaataagggctgcggcaagattactcccgccttttcgccctagagcagcaattgctggtatatttgattcatataaagcttgcttactctcagcagcctcaacaaagccaactggaacaccaattacagcagccactttaagctgctcatcattaacgagttcaatgattttacaaagagcagttggtgcatttccaacaataaatatcttttctcgtggatcgttagcagcaatttcaacagccgccattgaacgagtaatccccttttcttgggctaattgaattacacgcgggtcccggattaagcaatgataatcaacacctaatttatcaaggcgccgtttgttaattcctgataaagccattgtagtatcggtatagataacaccatgatttaatatgacatgttttaatttatttaatacatcatgcgtaaattttaaatttttcaaataatcaaaatctgctgtcgtatgaattgcccttttgattactgcttcttgtaatggactatcaaatttataatgcggatcaattttgtcgatctcttcttgaatgatttgaaaacttctatccgttattttatgaggtactgtaatatagctttctttttccattttcttcacttccaaactattaagaatcgtataagttcaaatccacataatcccaggaatgatgtaaggtacaacattgtaatcgttctttttaaatgccaatttgcagcaattacaagatgatcattaccgatgtaaggctttttaaccaattcgccaaaataataatgtggaccacctaattgcaaatgtaaggcacctgcaacaacagcttcactaaaagcactattaggacttagatgcttctcacaatcacgttcacctacagcaattgcctcccgagtgtcatcacgtaacaaccaactgctaataatcagtagtaaccatgtgattcgtgctggaacataatttgcaatgtcatcaattcgggcagatacctccccaaaagcgcggaatttttcattctgataaccaatcatcgaatctaaagtatttatggctttatacattattcctaaaactggaccaccaattaccaaaaagaacagtggcgcgattacaccatcactagtattttcggcaactgtttcaatcgttgcttttgttacctcttcagcacttaattgattagtatcacgtcctacaatcatccccacctgctggcgagctttatttaaattattttgttgaagacttttcataattttttctgcttcaattgccaattgacgcatagagaggcaagtatagcaaaggtaagttccaacgatcatatagagataataattaattgccgcaaatcgcatcaatatatatgtaattaatcctgacccaccaaccgttattagccaagtcaaagcgccaaaccacttctttcttttcgttgaatagtttgaacgattaaatttcttagttaggtacgcgattaaatgacccattgctttaactggatgcggccacgaatgagggtcaccaagtaaaaaatcaaaaatgaatgctagtataaccattattaggatattcattgcacatcagctcctaaattatttaaaaactgtatgaatagctttggattctgataaaaatgaacatgtagataactggcaaaagtttttctaatctgataacctcccgaccaagtatcaacaatttggttatcacgaacctttttcataagcaaaactggctttaattgctgatctaattgcttaaacatagaatgatgaaattcatgaccaacaatcttttgccctctattccctaacatacaatctacttgggtataagcttcacagtaaccaaatcttttaagtcgcggtgtcatctcactcataccatcaaaaattcctaccattggaaattcattttctccttgctttaataccttgccaagatacattaagccaccacactctgcataaattggcttatttgcttgcgaaaactcatagacttctttctttaagaattcattagctgccaatcgggaggcaaactcttcaggatatccgccaccaaagtacaaagcatctacatccggtaaatgattgtcagaaattgggctaaatggaattaactctatgcctgttttttcaagaaggtgaatgttatcagcataataaaaattaaatgctttatctttcgcaattcctaggcgaagtcttgttttgggaatattaaatggatcaacaactttctcactaaccgaggtagctaatgatagtagtttttgcaaatcaacatgggcctttacatcttcagcaaccttagcaatttttttatcaacattcggcaactcatcatcaggaactaaccctaactgtcgagaaggtaagctgatggttgagtcatgaggtaaataacccaaaattgggagatcgaggtaacgatgaatcgccccagcaattagtttgtaatgattttcactcatcacattattaatgatgactccctttatcggtacctttttatcaaagtcaataaagccctttaagattgctgcagccgatgtcgatgttgctctagcattaataactaaaataactgggatatttaattgtttagcaatactagctgttgaataagcatctttatccgttcctaaaccatcatagagtcccataacgccttcaataattcctaaatcaatattttccgtattagcagtaaaaagatagttcaaaacttgtggatcaggtacaagatagttatcaagatttcgagttggacgattagttattcttgtatgaaattttgtatcgacgtagtctggaccaactttatacgattgaattgtatatttttcattcaaagcttttaaaatgcctaaaacagcagtagtttttccagacccacttgttacaccagcaattagaacttttttcattacagctcacgtcctaacacttgttttaatgtcttgactaatagaatattatcttgtgggcccttaactgccactcgatagtattgtcggcccagcccagcgtaatcatcacattggcgaatcaaaatacggtgacgaataagcttttctcttaattccaaatcattgcttttaaataaaaagaagttagtagcacttggaaaaacctttatttcaggtattgcttgtaacgcttgatatagtgcaggttgctgaatatttaaccaatcatgagttaatttaatatatttttttgctctaaacatattttgaccaaaaacatccgcaatcccatttaccgaccaagtgttttcttgaactttaagtaaagtctttaattttttattttttgtaatacaatatcccaatcttaatcctggaattgcaaaaaatttagtagccgcccggataatataaacacggtcgtcagcttcaagttcattaataagactttcttgttcgttaacagttaggtcaataaaggcttcatccaagatcaaaaggcgatgatgttgattacaaaagttaactaagttccgaagatcttttagtgctattatttgaccagttggattgttaggacttgctaaacaaataattgtaatttcacgatgcgcttttagttgttcaatcatcgcctgtacatcacatgaaaaattatttttttcgtataattgataatggtgaacttttattccaacacgcttaaaaagtcgctcatattcaccaaacgtaggcgctaggactaacgcatccgttgccttttctgctcgaattgtctcatccaagacttccgatgctccattaccgacaaacacatcatcactattgacattaaaatgattagcgattgctgctttcaattctggatactctggatttggatagacttcaatattagcaaatgattgaactaatacgttccataaatctgacggaaaccccagaggattaatatttgcactaaagtctttaacctcttcaataggaatattcaattgagtagcaacttgctcgatattcccaccatgatgaatattatttttcaaaaaatcacctactaaaatcaaagaaaacgttttctaactttttcacctataaaattacgatgtttaacttgatagttcaatacttaacaacgcataagacgaataagcgatattagtgtttgaatatgtaaaaaaaacattaactatcttttcttgcagtccttattttggtgtttttttgttatattatttgtatttttttataatttcgcttttcaattagtattcagttcttgtaatagtgatttctttgctggattttgaaaaaattagtattatttaatagattatgatgaaagcgttattataatctgcctttttaagacccgaaatgtcaatttaaattagaaaaaagttgaaagctgttcttctgtgacataactcatgaatacttctagtggtgtacgataattaagagactttcgtgggatattgttgcgacggtgcattagctgagtgactagttcgtttggtaaatggcgaaaatctagctttttgctaagaccgtcacgacgcaagatgccgttattattttcgtttaaccctcgttgattgggagcaccgacttccgcaaaataggtatgaagatcatacttattggctatctctcgccatccagcaaattctttcccattatcaaaagtaattgatttaacaaagtgacgtggcagtttagcgagccattggtcaagctggcaattcactgcttcgtctgttttatgatgaatattaaggacaatcattactttggattgtcgctctactagcgtcattaccgctccgcggtgagctttaccttgaactgtatcagcttcaaagtgtccaaattcatgttggtaatgcggaaaatcacgatatcgttgatagatactgcgtcctaattggccagctttaccacgatgttccacatagccattgggatggcgttttcctttcatcggtagctgtttaacggaaaagccatactgattgcgggcaaacatgcgatagagggtgcgcatactgcaactaatcgggtgttcatgacgaccaataatagtatcaggagtccaaccagccttgatttgtgcatggatatagttaacctcgatagttggcagttgggtctgcttccgaccacaacgacgtttatgacgctgataagtctgaagatattggtcgatggttttaccgttattgaggaaacgataaacacgatagatggtttcttgactacgttgaagtaatttagcggcccgataagctttagtgccttgataccaaaaatcagctatgagagttaattcgcgtgtggtaagatgtttataggtcatttgtgattgcctttcttttgattagggatactcaaaagtctatcacaaatggctttttattttttctaacttaattttacaaacagcgagataaaataaagcaaaataattgagaggacagataagcagtgaagatttatacaaaaaatggtgataaagggcaaactaggattatcggcaaacaaattctctataaaaatgatccacgggtcgcagcatatggtgaagttgatgaattaaattcttgggttggttatacaaaatctttaattaattcgcatactcaagtactatccaatgaattagaggaaatccaacagttattgtttgattgtggccatgatttagcaacgccagcagatgatgaacgtcattcttttaaatttaaacaagaacaaccaacagtttggctagaagaaaaaatcgataattatactcaggttgttccagcagtaaagaagtttattcttcctggcggcactcagctagcatctgctcttcatgtagcacgaactattactcgacgcgctgaacgtcaaattgttcaattaatgcgtgaggaacaaattaatcaagatgtgctaatttttattaaccgtctttcagattatttttttgcagcagctcggtatgctaactacttagaacaacaaccagatatgttatatagaaacagtaaagacgttttccgctaaaggtatttatacaaaaaagaaccgagattttttcatctcggttctttttatggttctacaatattattgaattgtggacgagtttcaagataacttttagcgaatgggcagttagcttttaacttactatcagctccttcaaccagccacattagtaaggtcataatctcatttgctaatccctgaccacgatatttctcattaacttgaacttcttcaattgcaataatcttattttttagatttcttaactcaattgttgcaattttctcgccatcatcatttagtaaagctagttctccaggttgataactaaacttataagtcatatcgacacacgattgatgtgacaagctactctcattgataaattgctcaaaactcttaatatcatctcgtaatcttttagctaattttggatcatgattatcaccatttttaaagactgattgaacattactaattgcaatcgtacaattcattactttcattccaaggtagcggagcacttgatgaagatgggcattcgctattattccacctttttctccagctgaatcagtaatcaccaaaacaggttttcctaccaaatgttgatttggcgaaggaacagagagaatatctagtgcattctttaatccaccaggtaacgaataattgtattcctgcgtcactattaataacgcatcaacactatcaactgctttacgaaaagcgttccattcaattggcgtattttgatgttcaaaatcaggattgtaaaatggcaacatggaatatttcagttccacaaattgtaagttacttggtaatgaagtaaaatactccgcaatttttctactataagaattgacacttagactaccaattaatacgccaacctttaccattttatcatcccttctctatatttactttgaggcagtttttactaacccttctgcaaacttgttcaaacgctctatatcttcttcatatggttcaagatcaatttttactttttctgctcctgacgtggcaccagctttcttgaaggcatcatcaaaatgatccacagtcgtattgaaatactctccataaaatttatcaccggaaccagcaacgccatagactttgccagttaaatctgttgattgtaaatcatcataaaaatcaagcccttcttctggcattgccccctcatcatatgtataagcacaaacaactaaaatgtcagccttcataaaatctgctacatcagtttgtgatatctcagactctgtcactttaacatttaaattagtcaaactatcacatacaatgtttgctacttcctcattattaccagtcatcgtggcataaactacatgtgctgttagcatctataattcctcactaatctttttttatctatggctatgtgtaaccgcttttattataatacagataaatagtatatttttgtagaattggtggaggtatttaattatgaaacgaactatgtttatcggagcaatagcatgtggtaaaacaacccttactcaacgattagaaaatcaacaaattaaatataataaaacacaagcaattgaattttcatcaaatattattgacacaccaggagaatatatggagcatcataatatgatgagcacgttacgtgtaacctcgatggatgctgatatagttgttttattacaaagtgcggttgacaaacgacttgttttcccggctggcttctgttcaatgttttcgaaacctactttaggtgtagttacaaagattgatcttgtaaaagaccctgccgacattgaatattccaagaatcttctgttaagcgctggggtaaagaaggtaattcctgtttcggcagttgaaaatattaatatcgataaattagttgctgaacttaattaaaaattctaataaggtgattaattaaatgactattccaaataatatataaacccgctaaaacataaacaattttgcttccaaaattaccatatttttccaacaaatatgccacaggttttattaaaacaaattgttttcctaatagaattaataggactgaacaaatttcaaaaattattcctacgtatataatctgactccaactaaggttaaccaccaatggaatataaacagcaagattatctccaccaaggcttaaacaaaacagaagtaatgagagaaaacttgtattagttgtctttttttcgtcatcctgttcaaaaagcgctataaagattaaaataatgcccataaatcctgtaatccaatctggaaatagaaatgctagcccttttcctaaaattaccccaaagatccataaaataagcgttgctactccaaagccaataatcggtaaccggtaattatagtttcgtaaaagaaataatagtgcaataaacgtatcaatattaagtcccacaaatatcaaaagaattgtaataagactcataatatcatcgtccctatgaacggtcgattataataacatattcgttgctgctttaatgccggattcaattggatcttactaatacttagattattgggatttttgaatgaagtcccatcaatattctcaagacacaacgaaatgatattttttattatccagccatgtgtaattattaaaatattttgttgtggatacttataagaagtatccaataaaaatgaccatattcgtgcacgagcatgttcaaagttttcgccttgatttatcaaaattgaatgtggtcgcacgtcattcgtttcaacatcaaaatacatcgaatactgttgctttaatttactaatatctgccccattccatttaccgtaagatatttctgctagacgttcatcaacctgcaacttaatattagtcgtagcacaaattatttgccccgtttttactgctcgccttaacggacttgtatagacataatcaatttgattattatcaaacaatttttgataattcgctgcttccagcattccctgtttggtcagacttgttaatctatcatttaatgtaccttggatataatttaatcgattagcataggtttccccgtgacgaattaaaaaaaagttgtcattattaccatccacctataagaattatgtatgttaaagaggctattcaattctagcctcttttttagccattattatatcaatggcttttaatttttactaagcctaaattcactttgtcagatataagtatcttagttgttcaaccattgaatcactgatttgtaacacatcttttaagtaagaggtcattccaccatatttattattaataagagagattgcttgatcataataacacctatttgctgttgaaagatcgtaaattgagtgaagataattatcacctaggttattttttatagcataacgtaatcgttcttttatcctttttgttgatgctttattagttaaaatataatcttgataaattatatctactggaacttgtagaagacttagtaaataaattgctcctaaaccagtacggtctttccccgcagagcaatgaaataaaacaccaccctgcgctgaatgtaggcataattttttaataaaggtgtgaaatgcttcttgtgctttctcatcagtgacaaattgacaatatacttccatcatgcgattaaaacccgcttgtggatcctttgaaaaactttttcgtgcttcagcaatactaatattactttcagtaaggtcattctcaaagaccggtatccgaatataattcatcaatgatgttaattggtcgggataaaaagctacttcggaagttgaacgaaagtcaataattgtcctaataccatatccataaagttttctttgctcattatgtgtaaaataggagagatgcgcagaacgaacaagattattccatttcagactttcgccatcaatagttctataaccaccaagatctcgaaaattaaatccattttcaaacgctagaattcgctgatgattcgccatattgcatctccctcctttctaaaaagtgtattcatctactacacgttagcgtaaatgaatacacttctaatgttatgttcgtgtaatttcaggaacatcaaaccccagtaacgtttgtagcttatcaaccacatgacgcaaagctgattcaatttcagaaacttctcccacaattacaaccgagccactaaatcgatcaatgaaccctagagtaacattactcgactttgtagcaatatccccagcgataattgaggcttcacttggcgttattgtcaaaataccaagcgcatttttaggagtttgtatccctaatttctcataaatgtctggcgtagggttagcaacgatatgtgctaatgttacctgtttacccggaacatattcttgaattgtccgtttgatatcctgcctagccatagtatcatccccattttattgctgagttacattcattacatcacgggcaataattatttcttcgttagttggaataacagctattttaaccttactatcaggtgcttcaatgcttagctcattatttttatttttctcttcgtcaattttgactccaagatagtctaaattcttacagatctgacttctaatataagcagcatgttcaccaattccggctgtaaatactaatgtatccaatccatcaagatccgttgtatatgctccaatatattgttgaattgaatgtacaaatacatctaaagctaattgtgcccgttcgttaccgtttttagccgcactttcaatctcacgttcatcattagaaatcccagataagcctttaagccctgagtcttcattcattattcgacgcatttcatgtgaatcaatattgagttcttcttcaagaaaaggaataatttctggatcaatatctccacatcgcgttcccatcactacacctgctaacggagtaaagcccattgaagagttaaccgactttccatctaagatcgccgaaacgcttgatccatttcccaaatgacacgtgatcatacgacgagtcttttctttaccaaaaagttcacgcgctttttctgacacatactgatgtgaaggggcatggaacccgtagcgcctaatttgatacttttcataaaactcatatggcaaagcatacatataagctttcttagggattgtatgatgaaatgaattatcgaaagtaactacttccttggcatctggaagaaacttttcaaaggcttttatccctgctagtccatttggattatgcagaggtgataacaccttcaattcatcaatccgtttttcaacttctggagtgactgccactgcatgagtatagtaacttccgccatgagaaatccggtgaccaacaccataaatttctgacttatccttaacaaccccactagacattaaaacatcaataatatggtcaattgcctctgagtggttttttaaagggatttgtcttgtctcgttagttttatcagttttatatgaaagctgacttgtcgaagaaccaagattttcagcagaaccactaattaatagtttctcctctggcatcaagtaaagtttgaacttaattgatgaactaccagaattaattgcaagtattttttttgacatcaaatcactccaaataaactaaattaacgaattattgcttcgtaaaccatcttcagatcattatctgaaggaacaactggattgccagggaatgttgcatctttcttcgcatttgcaacaacagtatcagctaattcttcagctttagcaggatcaacaccgaatgcttgaagagtcattggacaattcatttgtcgtgccatttccctaattttagcaattagtcgctttactgcaagacgatcgcctactccaggagcagcaattccagctttcttagcagcaattgcaaacttatgcaatgcctcttcactatgttcagcattatatgcgataacatatggcaagagcattgtatttgctaaaccatggggaacgtggaaattagctcccaattgatgcgcaattgagtggcaaatccctaatccagcaatattaaatgcagttccggcaatatttgatgcttcatgaacaatcttacgagcatccacattatcgccgtgacgataacactcaactaaatgtttaataacggcatcaattgcttcttctgataatgcaactgtgaataaatttgcatccttagcaaccaaagattcaagtgcatgtgttaaaacatccattcctgaatatgcagttacactcttaggagcagtcataactagtttaggatctagtaaagcacaatcaggtgtcaaataatcttccaaaataggaattttacgatgttctttcgtatcagaaataaccgcagtattcgtaacttctgaaccagtaccactcgttgttggaatagcaatatattcattgatcttgcacttgcccaacttttcaccaaagaaacgaattcccttaccagtatccaaagctgatccgccaccgataccaatcacaattgttggtttaagtttaaggaattgttgaaccccttccataatcttatctagtggaggatcggggacaacatcagagaaaatttcacacttattattatccttaatgtgactctcaatttcttttaaggtatcactaccaggcaagaaagaatcacagactaataaaatacgttcattattaagtgtctctagttctttcaaactatctgttcccgaataaatccgggttggcatactatatttttccattggaattatgcctcccattaataccagttacgtactgagaatccttgtggtgagttcaaacgaacccgacgagtaaatgttcgtgcagtacatgttccttcaccagttggcgtagcaattgttaatgctgaagcacctgagtgagctccattatctgcaacacctgtaccaacataggatgggccattaacaacaaagattgaacattgcatccggtgagcagcattattaatatgcttaaggttattggaatgaatagtagctgtgtgatggttacctttttcaacttcaacagcagtcttcaaaacatcatcaaatgttggacaagaaacaactggtaaaattggcattaacatttcagtcattactaatggatgttccttaggaagttcacaaataatttcaactgggtggcctgtgtaaggaatattagcttggtctaagatataagttgcatccttaccaacaaatttacgatcaggagcaccattttcttggatacacatatcagctaatttatcggcttgttcacggttaactacaaaggcaccttcatcttgcatcttacgaattaattcatctttaatgctactttctgcaactacttccttttcagcagtacataaaatatcattatcaaatgaagcagatgtaatgatattatgagcagctaaatcaatatcagcagtagcatcaaccattgcaggaggattaccaggaccagcaccaaccgctttcttaccactggtcattgcttggtgaacaacagctgggccaccagttactgctaacattgcaatgtcggggtgcttcatcatttgttgaactgattcaattgttggtgtttcaatacttacaactaaattatgaaggcctgttgcatctgcaataaaatcgttcatcttttcaattgtccagcgagtaacattctttgcgccagggtgagcaccaaagtaaagagtattaccaccggcaagcatcatgatcgcattagcaattacagtttctgaagggtttgtacttgggccaaccgcaccaataacaccatatggtaaccgttcatacataaccatcccaccgtcaccgttttctacaactggttcaagaatctcgggaccaggagtgttgtacaaggcattgtttaacttagcaattttggcctctactgttcccattcctgtttcttctttgatatctttagccattttttcaatatatgggcggaatccttccttaatggcatcaatcacttgttggcgaacagcaattggcttatcccgatatatttcttgagcagcttttgcagcagcaattgcatcattgacattagtgaaaattccgcgatgaccattatcagtagtagctgcaacgtttgcacttgaagagctggcattatctagttcttcggcaagaattttgcgtacagcactttcaatatcattaatctgcatatctacttactctccttcaaaaattctgcaacagcagcttcacaaattgattgatcttcttcaaccaatccaccactaacaccaatcgctccaataatttcatcgttaatcttcaatggaataccacctgcaaaagatgctaacttaccatcaagcattgtttccatttgatataatccggcacctggttggatatccttactaatatccttggtaggttccttcattgctaatgctgaccatgcctttttaggagctaaagtacaacttactaaattagcatttggcatatggtagctcatttgcaatacttgatcagctttcataatagcaattgttactccaacacccaattcattagcacgagctacagccgcatcgattactttttccattttgtgccgatcaaatagatttttagaagcattattcttgattacgttttcaacaatcttactaatttgttcctcgttcattcttaacgcacatccttttcttcttgataacgtttgtaaatttttaacacgtcatcagttacactatttaataaatcttcatagtcttcatcacgcgctacaatatataaaaaatccgacaaacgattaatatatctttctagctctggacgaaattttacattctttgatagccgcacaaatagtcgctctgcacgacgacagattgttcgacaaatatgaagttgtgcacccgcagtactcgaaccaggtaagataaaactatgaacaggtggcagttttgatgtatattcatcaataaccttttcaagttttcgagtatcttcatcagtaataatcttacttttatcagtaaaatactgccgtttttctgtcgctatctcaccttgaaggaaaaacattttatattcgatctcttgtaaaagcttcttattacgtttactttcacagaatttatctgccaaactaatattagcgtttaattcatcaaaagttccataagtttcaactcgtaatgaatccttaggtaccctcgttccatcgaataaacttgtttctcccttgtcaccaccttttgtgtaaatagccattttgatgcctccaatgcacactacttatcaaaacggtcaattattccaactatcgtacagtcattaacgtcccttacttgatcctcatcacgctctttatcagcacgtcttgcaccagcaccacgaactattaatacattatcaccaatcccagcatttactgtatcagcggcaacttgttcaaatcgaactggttgttggtcggaattaatctgttgaactatcattagtttctttccaactaaggatggatccttttgggttgcaacaacactacctactactctcgccatatacaattttcttcagtcctaatctttattttaatttttttatagttacagatatcaagtgcttcatctgtaatatgttgcttttgatatctaacaagaatcgatttatctggtttagcagctatctcttctctggtaataatccgattataactggcaattactggcgattcgttatttacaacaaacaagatcggccagtccaaaatcatcatccgtggaataaaattaaccatctgttcattaattaaaaagtaaaatttaacatcatagctaattccttctaacacccatttaacccaagcgttagtcttttccattgaatataagtccgttattaactcaatcgaaatatcttttagaataacttttccgtttctcaaaaaaatctgttcactaggcggggcaacttgatgattaaaagtaacttcaacgctcgtatgctttcgttcttctaatcgttgcataacctgttgtactaggttatccatctattcacccccttattagtttctcaaaaagttagtttttcttcttgataataacttttccgaaagaattattacctagtccgacattagctgcattggcttcatcagtatcaatatgcatttcaaggacaaagtcttcacgagggcgagcaactacgtcatcaaaaatggttttacgtccaccatcgccatctacttcaacctgcattgaatcaccgagctttacgccaaagcgcttggcatcttctaaactcatgtggatgtgtcgctttgcaacaattacaccttgaatttcaatttccgcatatggtgaccgaaccttaattgaaggggtgccatcaagatcaccagacattctaattggagcatcaattcctagtgtaaagttttctgaacgggcaatttctacctgtgagtgtgaacggtatggccccattagacgaacatgttcaatggtgcctttgggcccgatcagatcaacagtttgctttgcagcaaagtccgcatgttgacgaagtttctttagcatttcaatcttttgaccagggaatagcttttgaaagtcttcttccgtcaaatgtacatggtgatttgaaacaccaattggaactaggttaggattaagtgtttctctaacaatcgtccggataagtgttcttaaatgttcttcatccatacgtaatcttcctttttattaaaattttctattcagcgtctgaatctgatccacctggtaaaatcttttcaacttcttcatgtggacgaggaattacgtaagacgatacaacttcgccgacaccttcagcagcttgtacaccagcatcaacggcagcctttacagcaccaacatcaccacgaatcataacagttaccaatccactaccaatcttttcttggccagttaatgttacattagcagcctttaccatttgatcagcagcttcaatagatgcaactaatccgcgtgtttcaatcattcctaaagcgttattcatagttatttcctcctactttttctttaattcattgtaatggatacacttcttatgcggttctcctaatttccgtggacattttggatctccacacatattgcatgtgacttcattatcattagagttggtatcttgtttatcattagacgaatccgaagcttcgatttcatctttgccctctaatgatcgctcagtttgaacactaggttcagcagaattttcactattctgtactatctcttctttaattgaagatggttcagcaaccttttccttttcagcaatattttgctgcttttctggatttggttgcaataaatctgttttgcccaaggagttcaaccctattgctggacgccctattatcgctgacgttacatatacatcaggtaaatagtcttttacagcttgaaccgcaacagttatagctgatagttcaccagaaacttgtaaggtgacccatccattacctttcgtattttgaatactactaagttcaacatctgcagtttttagcatcctgtcagcagccacaatagcgccagataatccattacattctacatagcccaaagacttcataattaaatcacctgtttgccatttccttaaaagggattccttttactaatctcgctgcatttgctcctaaaattcgtaattgctttttatcattgattgtcatatcaaataaaggctgattttcttttaagttcttatagtgaacaataaaatgatctccttcaaaagcaattcctacagatagccttgatgcaagagctgattggtatgctctttcaacagtatcatttatattgattttacgaactgagactgggatctgttcttcttcaattccataaaaaagtggcttgacactatctggaatcgttattccattttctagtccgacgacaatcgagggacgttgtgaatcatcgttgttcataacgcttccttctttcttcgccataccttaaaatcaatccagttgcaacggcatttcgtggtccttcaactccacgaacatttcctcgaccagcaactaaattaaagtgtgctaattcatctgtaacaagttgtggaatttcaaagtctaaggctgaaccaccgacaattacaacaaacggaatatcacgaatatttccagttggactaacatacttaagtgcccgtaaagcgttcgtaacaaatactcgtttctttgcactttgacgcactaatttaattttttcaatgcttggattcccagttactggttcgtatccatctggtttaattactacaactttggcaaacagtgatgatggaagcggatctttaaagaattgaaccgaaccatcctcatgtcgaatttgaaaaaggttttctacctttgctaatgggtagcgtttgatgtcttctgcaagatgaatatcattcaatcctaattcagaattaataatcatcgttaccatatcaccagcaccagctaagtgaattgcaactgtattattttctttattaatgattgaagcatctgttgagccagcacctaaatcaaggattgcgattggcttatctgttcctggagttgttaatgctccacgaattgcagattcaacttcagcaccaccaatttcaacctttgtattaaattctttttcaataagtttagcaataacttccatttgaagatgatctgacttaaccattgctgcgatcccaactgctgattcatttgagaattcaccagctagaccgcctcgaacttcaactggtacttgagtatcaacagcaagtaaatcttgaatagcaatttcatcatttttctttcctgtaagatctgccattgtttgacgaacattttccaacattcctccaacattggttccagactcaccagttatattgttaatatggcggaaactagaaacctttttcataatggcgtcagcaccttcagaaactccaacttcttcttttccagtatcaccattaattatgattttacctgctggaattactcgcgctttaacatccccagctggagtcttaataacaacagccgaacgatttccaataagcgctcgagaaactggaacaatattcttagtctcttctggagttagtccaaataaggtagcgataccatacgggtttgaaagttgtgaaattacttgtccagggccagcaacttctacagctgccagcatatttaacggaactttgtcaatcatagcaacttcatcgacaatcggaattttatgatttaaccgattatcaactaaaacaccatcatcgtttcttagaattgctgctgttattttataaccagaggcaacataagcattgataagtttagcaacgtcttcaaaatcaatatccttaggaactacaacaatataatttttgcttttatcagttttctttaagagatcaagcaaacgaactgttatcccagcccctgttcctataccacctggtgtattaggattatgcccaatcattgttgattctgttacaactgtttctgtaatagtttccattgcaacatcaccaattactggcgtggcttcattgattcgaattaaatcaatatcatcgattgtcagattagatttattcagaacttgagtaattgaatccctaattccaactagattctgcttagtacctttaatcccagtagtaggagcaataccagagttaataaagtgaacttgcccactatcgcttacatctgccaatgcaacttcagtggaagaattcccaatatcaacaccaattactttttcagttgccatacataaaactccctactctgactaaaaagcttagttatcgccctttagcttcttacgactttcataataatcagcagcttcttcaaaccatgctgcgcaaacattagcgtcatacttgtcccgtaattcctttgcaatgttcaataattcttgcttagttgaacggaaaggacgcaatgcatcatacatttcaagaacccgttcgtcaggtactcgtgttaattctgcagctcgttgaagattcttttgaatagctggacggccagcattagctgcaatttcaccttgaagtttcaatgcttctggtgtaatccgtaattccttaggatcaacttgattatttactactttttgtaaattgatgtcatcaagattgtgtccttttggtgtttttactaaatcacggtgcttttgataaagtgggtaatcatctgctgtcatttccttactagtacttgcagttgaagtacctgtagagctattagcagatgaactgtttcccatctgagccatgatctttgctactaaatcatcaacttcactcatcattctgcctccttaatcaaacgtaaccttaatttcttcttcaggcttaccaacaacaacttggtgagtttcacgaatatgcataattgctgaaatagcttgatagtgaatacgagcaagttgatcgtttttagctggaactggttctggagattcacccttagcatacatagcggcattcttaccaattgcacgataagtttcgggagtaagtactggcgcttgtgggaataactcaaggttaccaagagggtcttgatccttttggtgaataactgtcgtcccttttgattggataccaatagcaattcctgaaccagaaaggtgatcaccttggacagcacagaatgctacatctgaactccggtaaactttaactacccgcgccttaagcccttcttcttcaataccagcaataacttgacgaagcacttctttatgaggaataccagtttctgtcttatcaagaacagttgcgaatgcaggaccgactgcaattacaacttcatccttagaatatccaggttttgcttctccaactggttggaaccagtcaagtttcttttctggaacagctttactatttggttgttgcacctcttgagttgctgttgcagtactatcattacttttatcaaagtcaatcttagtatcgatttgattagtttcgcttaaaacttctttaacgattttacgtaataagttttcatcaatatcagccataacagattacctcctctctacagttccaaatgttctggatcaagggcgaatggtaagtctttaatccgatcccattcttccttgtcttcatatagacggtatccagtacctggtccttgataatcatttccgtcgttaacagcagaagtgacgttccaatctttatcaaaaatagaagatgtttgaaggtaatcaccaacaactttttgtttttgaaggttcaaaattgcttcagcgacatctttaaatccgtggttgtacaatgccttgataatatcaatagcagtaattccacgatccatcatatcttgagcagccttcatatctgcaaccatatcccgctttggcatgtcatcatgggtgttagcatacgttgctgcttcgacctcttcatcagtaatctttggtaatccaagatcttcaaatactgcttgaagggctttagcggccttattacgtgccttaataatggtttcttccttaacagggtgaataccataatattgacccaagtcacgttccataacatacatatcatcgtagtccatagcatcagtgtttgaaccagcgaaggtattatcgtagttaggagttgatgagtaaccagagttaatataatcagtaccggcaataaattgaccaataaaccgttcagtccgccgcatatcggagtgtgagtatgcttggtcacaaccagaagcacattcgatgtcacacatcatacataacaagttttcaccgagaacttcacgaataccattaggaacagcaccaggaatttcaatacaacttacggcaccattttgaagtccttgaacacctgaagccttagtaagtaaaatacaacgcgcttcaaggtaaagcattgacttaccttctggataacccatcaaaacttctgaaccggcacctgaagtaaatcgcatcttcaaaccacgtgatgcataacaagatgccaagaagcctttagaccatggagtatcatcaccatcggtaaatacacgatcagtaccgtaaactgaaatggtttcagcatatgcggtaaaaccacgcatacctaattgcaattcagtagcttcttcaacagaacattgtgtcaatacaccagggcgacctgtttgtgcaccaattaaaattgaaatagcattgaatggtgcataacgtgccacagctgtcgtggtttcttgttctggaaatccacgaagagcggcatcagcagcatcagcagcaatttgaactgggttatcaacagtattggtaacgtgacactggttgtcaggcttacgacgtgggcgcatcttcttgacagccataatcatttcaccaaaatcaagcttactgatgatctcttcagccttagcaggagtcaaagctgatgtaatttcaataatttcatcacgagaaacattaggatcaacaagcatccgtgcaatcttggtagaatccatattcataactttttcaacgttgtcaatattgattccatacttagcaatgtacaagtcaatcaaatcaaaatcttcgagctttttaccatccatctctacgatcttgccattttcaacttttacactaggcttagggtcattaggccccatcattgcaacgaaaccttcttctggccattctttaacaaatgtatcttgatgaattggccgtttttctagttcttcaaatcgtttttgacgtttcataataaagtagtcctccttctagatctacttaatgtatgatgggaaatcattaactggttcttcaccaaactgtgacaataactttaatcctacttcacgtccagccataacagcttgacgaacagctcctgagtcaccggtaatagttaggcaaccttcgttagagaaacttgtaccatgacttggtgaagtaaagttaagcggttcaacaccagcagtctttaaagccttatctcccatcacgacaccaatcccggaaggacaaccacaaatcaacccaaatgctttcccttcaactgcacctaatccaagatgtgcagcacctgcagcacgagctgtaaattgtaattcaaggtgacccgctttggcgttataaacgtcaccaaatgtacgatgaagattatcaagtgcaacccgaatagcttggcgtgcatctgcaggatcatcaccaccgatgataattaaacatccatggcctcctccacctttagtatcacgtggccattcaacatcaatacattccatgttagtagccttaattccttcatccattgccataatttgtggaccagcaccagtacgatcactcaaaatacctaaagtcttgtattgttttgtaacgtgtaatttatctaatagttgttgatcaactctcggaattaccattccaatggtatctccaatttcgctagcaccaacaaattctggaacagtactagtagaattcagaaaatcattcattatttttcctcctgactataaaagctcttaacaataaagctcttaatacagatttctgtacctagccgtctgtataagggctttaattttttatcaattattctccatgatgcggtaagagcttatcaacttcagattgaggacgaggaattacgtaactcgaaacaacttctccaatattttcggcagcttgtactccggcatcaactgaagccttaacagctccaacatcaccacgaaccattactgtgactaatccatgaccaatcttttcttgaccaattaatttaacattagcagcttttaccattgcatcagcagcttcaattgaagctacaagtccttcggtttcaattaaaccaagtgcttcttgtcccataagaatgcctcctaagtataaaaacaaatagcgataatgagaaatcgcttacaatttggtacatgttaattttataacatgatatttatgatatattatcttaaaaaatgtatgatacttaaaaagaacaataatttattattatgtatcacaaaatttacaggaaagcgtttttatgtgtaaatgtatgctaatatatagaggtaaacggcatctttcttaaaaaatttggtaaaaagtaggcgaaattcaaatgtacgaatattcttcaaaattcttgaatgacattcaaaaggtaacaaaaacatttcaggaaataaccaataataatataattttcacaagcattaccggagcaattgttgattgcaacacccttctttttgactcaaatatttcacttgaacatttacgaaaactcgattttaaaaattactttgtttttccactagttataagctcatctttaagtggtttctttgttcttgatgaatcacatatagaatcagacgctattgatttatgtagtaaatatattgaaatttcttgcaaaaattttattgacagttccaatgactgcatagctgtccttaccccattcgaggctcctaagctaagttcactaatcaaagtccttaatgggattttgaatatttctggagatgattcaatagctaacgttactaatcctcctattcttaataacagaaatgatggtactctaagtgatattgaaaaaaatataaccatggcgcttaaatacattaattccaatttagaaaaatcgcttactttagaaaacgtttctcaaaggatttatctctcaccatcatacttaagtcgaatctttaaaaattattttaatgacaattttattaactatataaatctacaaaaaattgcacttgctcaagaaaaattaattttttcaaatacaccaattaataaattggctcatcaagttggtttttcacagacaagttactttactaaaattttcaagcaaaaagtaggaatgacaccatcaaagtatcgaaaatataattccgcaataaagaaaatctatactattccaagagatttacaatggcgctcaaataagtccgtttatgaaatctcaaaagattttttcaataaaaatgatatttcctttaaagcccgtgatttaaatgggtatccatatatctattcaataaatgatctgaatgatgttagtaataaagcaggttgggtctatacagtagattgttctcaacctattattccagctagtgagattaatgtatttgatcgttcagtaattcaatggatttatactgaaaaaattatttaaaattaaaaagaggttgggggtgcccagcctcttatttattctaatcatcaaacattgcaatccctagtggcgtaacaaattgaggataaagcggtttataaactttacgctttaaatctttactaaaggttgttgtaaattcagtaaagttagttgcacctcccaccactattactggatcaataatttctactcccatattttgaacaattgctgccattttctcaactacaggtttaataacagcatatacttcagattctttattcttgttacgctttaatttttctgcttcatcattttttattttatatcttcctccaagaacaagcgtcatatgaaatccgcctgttgcttcatcaataacatggatgagcttgttatctttaaaaatactaatcccagttgttcctcctccaatatctacaactgtaccatttgacaatcttaagaacttcgcagctgctgtcggttcatcttcaacacctgtacaaagcaagcctgtctcttcgataacattagcaaccactttggcactcttctctcctgtcttcggtggaatagcaccacatgccgttttaagttcacgtcctaatactttctcagctttttcttttaagcgtcttaaaatattaactgattccatgaaattaactacaataccatcttgaactgcatggtcatattcatacgctccgtatacaatcttatctttggaatccagcactgttaaaacaattgaagaagttcctaaatctacaccgacctttagcttttcatcagccgtaactttacgtaaaggcttatccccattaacaatctcggaaaatttttttaattgttcattactactttttaaaaattcttttttcattaattttctcctacgagatatttcatattttatttaaactaaataaagaggctatattaattagcctccttttctctaggttcactaaactagtgccgtttgtaaagcacaagcaagaaggcccccaacaattgggccacacattggaacccatgcataccaccattctgaaacacccttattaggaattggcaaaatagtatatgctaaacgtggtgaccaatcacgagctgggtttaatgcaaagccagtagttgtcccgagacatgtaccaacaactgcaataaccattcctacgataaatggcttcaatccctgtgtaaagttgccaagatttaataagatgaaaataaatgcaaaggtcgcaatcacttctgagaaaaagttaaaaattggactatttatcgctggacgagtagcaaaaataccaacattatttccttcttcttcatttggggttgctttaaattgtggatagaattgaataattactaatactgcaccaacaaacgcaccaagaaattgaccaagtaagtaaggtataacgttactccatgggaataagccaaaaatagcaaaaggaattgttacagcgggatttaagtgccctaatgaacccagaaatcctgcaacataaactcccattgtaactgctaagccccatgaaatacagataaaccaccagccactttgtttcccatatgttttattcaaactattaccagcacaacatcctgctcctaataggattaaaaccatggtgccaaaaaattcgccaataaatccatgcatgtctaaacaccaacctttttatattattcccaaattgtatgcgttttctatacatataatgctaacacattaattatgtattttattgtctttattggattaactgttcaataacggcaatattttacaaattaatacacaaaaaaatcatgttccttaccagaaattattagcttttctttaaaagaaaacctagccctaagaaaataatcaccaagaaaatcccacagtaaatatatctttgcggatgtccttttacgtgtccgtaccgataatcattattataacgttgcatggcccctattattaatccactaattccatttattgttggactaagcgcaaaggacgccgacactccacttatttcattattaataaagctaaaaataataaaaaggactccactcatcaccgttgaaattatcgttgcaagattaattccaactaacagttcatagataatactgttattagctggaaccttaacaagtattcttggcatctcttgccaacttcttgcaataaagaagatgagtaaaatgcaatcaccaataataaacggtaaagtccaaccattatgtaattctaaacttggcggagttacaatccctgcagcgcatagaactactattggccaatacatcgaagcaaattttcggcgtgattgcggtcgttccaggagagcaaaaaattgtcccaaaagagcttgtaagaaatttaaaacgataaatatcatgacccatatatttaagtagctaggaattaatactactttaggctgtccccaagctaagacaatcgaaataattaaaacaatagctaataacaaagcccttggtgcataaggggacagatttcgatatttttctgctcgttgacaaattagtatcagattataaatattcatcactaaaatgacagctgaaaccagtaaaacagagtcctgcaactgatttggggatgggggttgtccacctaaaataatatatgctgacattgtacaaagccatcccactgtccacatcaatggaatagttggtgtcaagattaatggctgacgcggcaaccattgttccatgtgaaacacctcctcaatatggtatcttaccataagaaattgctcaaaatctggtaagataaatagtagttagttttaggaggtaaatttttatgtttttaccacaattaggattaaaaggaagcagtcaactagaccaaattaatgatcgcctacaatataatcctattgcttatgaattttatactgatgctgatgattttactgatgaaggctaccaacgcctctatgatgcaattcaatacgttaaagatgctggaattaaaaatattattctacatcacccaatgaagtttcaggatcatcattcagaagtagtggctccggaaaaacagtaccccgacctataccgctttatcgaatttacaactgaaaagctcctttatttagccgatgaccttgatgttcaagttttggtccacggtggttatgccggtcctgaatcacgttactttgtttcactttatcccagtgtagaagctgcccgagatgctgtctatcagcgattggactattttgcagatgctggtggagagcatatcatgtttgaaaattcaattgcaccagtctttgcttacggcgatcctcttcaagaagatgaaattcttgcacataattatcgacttgcctttgatacctcccattgttttattgagcttcatgggaataaccagaaattaacagcatccctagaacacctaaaagatcgtatcgttcactatcacctagttgattcaatgggcaaaactcatgatagtcttactctcggcaccggtaaaatcgactgggctaacgttttacctcacttaaatccagctgctactagtatttatgaaattaacttacacgatcaaaataattgttgtgaacaaattgacagtcataactatttagttaaactttaccaaaagcttaataatagaggagtttaatcgtgaagcaatatattaatcgccgtcatatttctttagtattagccctatttgtcctctacttagcaatcacctattgggaaattgtcgctaaatttatccaaacaattttttctgcaaccgtgccgcttttaataggagcaatccttgcctatattgttaacttactattaaaacaatatgaacacctctacctatctttgttcaagaaaccaagtgcgcaaaaattcaagcggccggttgggataatgatgtcttacttaacaatcatcctaataatcgccgtcgtttttgccctggtaattcctgaacttattacgtgtgtaaaactgcttattgcaaatcacagtcacattattaaccattttatcgattactttgaacatagcagtgattttaaaggcttcatcaatagctttgatgctagtaaaattcaatgggataaaattggtaaatatcttacgtctggcgttggtgggactttccggacggttatttcaacagcctcatctgtattttcggctgccacaaccgcaattattgcgtttttcttttcaatctacctcttgatttataaagaaatgttgcaacgccagtttactaaattactttcaacatactttagccgataccagacgcaaataattagagttctgaaagtttttgatgaaagttacagtaactatattattgggcaatgtaaagatgctgctattcttggaatctcgtgttttatcggaatgacgatcttacgaatgccttatgcctccatgatcggagttgtaactgcatttggtgctttaatcccaatcatcggcgccatccttggggctagtgtcggagtaattatcatctttgccgtttctccacttcaagctggcattttcttgatctttattattctccttcaacagttagataaccgcattacctatccactagttgtcggaagatcaattgggctaccaagtgtatgggtatttgccgcggttattattggtgggggaatttccggaattcttggaatgatgttcaccgttcctttatttgcagccctttataaattgttaagtgctgatgcaagaaacagaataacaattcaaaaagggactgtgacataagttaagttactttcataaaaagcaaatacgcagtacaataatggcctccaacgtccggcaaaaccgaatattggaggcctattattgcttgcgggggctcgaaaacgaagtcacaagtgacttctgtctcgctcccattttttcattttttataaattatctggaacctctgcaacaggctgatctttagtcaggcgataaacttgtgatgcatttacaccaaagtactggttaattagcttgctcaattcttccattgcttcattagcacgttcaatttgttctggattaattgcttccataactgcaactacattttgagaatcttctgtcaacattgttcgttgagcttcacgccagtttaaacaacgacaaacagctccttcatcgtcataataaataacttcgccctccaaagcaggttcatcttcttcagcaccaactggccgaaatgcttcgccgccttttgcaacacccaaatgaaggtcgccagcaatcttatttcggtcttcaatgcctactggaacaccgtagctcaaggaaatactattgtagacatcaacaagaggttcaattggttcaaatttccgtccttgattggcacgcttcaataaggcctcaattgatgagcgcgcacctttctttttcttaaactgttgaaatgcttgacgccattgatcaacaactggattcaaacgaaaagtttcattagttaaaaacttatcagcctcatgagtagcatttgctaatagcttcttccgttcatcatagttgttatcagtatcatggttatcaatgccatttgcaaataagatgtttacttgtgcatctggaaaaagttcccaaaaacttggatcaatcgtcacttgcttcataaaaataatctcctctttataaattagtattgacgtttgcccccatgctttacggtatcccaatcaccatcaatatttttccggatacgaactagataatcatgaacctgttgagcctctttttccgagaagcctttcaatgcctccctatttgaaaattggttttcacgaataataaaaggataaatctctttccccttttgagtaacataaagtcgtttaattttcttattcgtcggatcactttttctttcaataaagccgtttttttcaagctttttaacagcacgggcaatcgttgttcggtctacttttatcaagtttgataattgttctgaaataattcctggatgctcataaatacgaacaacatataggtattgaccacgtgctaaatcgatttgcttgaactcaatattggcaatcgaatcgagggctcgatcaatcatccctatttcacgtaaaatatcaatcattgataaaaattctccttgtctacaatattaaaacgtttttgttgtaattgcaacaaaaaattcaaagctaattattttccaacggcgcaggctgagcaactttttgcattgctgttaataattgagcagcatccattcgcgataatactgacttcaatgctaaagtcattaatcgatcattttgtggattaatcacattagtacttggaatttcttctcccgctaaaagtgcatttaagatttcgacaaagcggtcataagcagcttgcgggtaagaattcatagtaacttgagcaattcctgcacggatatcatctagtgaaaaatttgattttaataatccaataagtaaaagatctactaattggttaacagcatactttttcttgatcggtgcttgaataactttcttttttacataattatttaccattgattttgtaagtggttcaattcccaaatggttcaattgttcatttacaattgccaccacctggtcaacatacaaacctagtgtaggtaattctttccatcgtggaaatcgcacccgtgctaaattattttgccatcgttgatattcttctaatttatccatatcacaacctgctttcttatggggcaattccaatcgattgattccgaaaatcatcggtagtaactgcttgttcaattatctgtgctacttgtcctaatccaatctctttgccttctaaagcatccccttcactaacaaccttaagcgaagtttcttcattagtaattggcaaagctctaataatagtatatggtaactcaaattcatcaatcattttaaccgcatattgatgagcaaggacagcctgagttgcctgttgtccataccattcctgtagttgctgattggtcgcatcatctgctgttcctgcaatcgaaagcattactatttttgatggtaaaaacagggaacgatcgatcaattcagctaactcttgcacttcatcatctacatactcattaacagtaggaagccaacacaacacatccccacgttgaatttcaaatttaaaactagtgagcgcaaccgcttctggaacccttttgataatagttggtactagagcgtcatgccggtgactaataaaaactatccgacccatcacaacctccaaatctattagtaagccatcaattcatcttcaatcgttgcatcttcaattctgacgtcagtaatggtgctttgctctagtaatggcaataatgtttgaatatttccagtgaaaagaaaacgggtctcattacctgcttcttccaacatgtgcgcccctagctttactgcattgtcgattgggaaaccagttcccattactgtcacagtacaatctactccatcattcatcgataaatcacgtgcagaagtcaaatgactgccattaaagtaataaagagtatgagcaaaccgcatcaatgttgaaatatttttacttgtgaaaagcactaaggcatcgaccttttgagcatagtctttaacaaggtgaccaatcatttgccgtttatcttcctccaagccgtcaaaggcatcactcaaaataacgattggacattgccaagtaaggaggagggctatccgtagttctagttgttgagcatcacttaatgcagcaatcatttgatcaggttcaaattttaatgatttaagcatttggagtgcttgttctggctttaaagcatttttatgatgacgtaacgcgtggtcaacagctttctccactgtttttccttttaaaaccacatcatcaattcggccgatttcatttttgctttgacgcttatactttttgaatgggaccccgttaattgttacatccccatttaaaatttttccacggacagataataaatcttctaatgcagctgctgcacctgtatcattactgcaaattccgattacttgtggtgactttagttctaatgaaacgttatctaattggtctcctgatttagcatcatagactaaatcattaattgtaatactactcactatataacctcttttcctaagctatctacctttactaatcttatcattttttaggtaatgaacgaaataaacatgtccttctttttaacatgctttaatttataacaccttatttgaatggtagaataatatacataaattgtacttaccaatcgaaatgaggaatgttattttgaatgagggccaactattcacaaattttataattatcatcattacgtttatctttgcagcattctttgtagcagccgagttcgccttagtgcaagcacgggtaacggccctagaagaaatgcaagcaaagcgcgataaaccatctgcgaaaataacccgtgcaatcaaaatggtcaccaatctaacggaatatctttcgaccactcaagtaggggtttcaatttgtggaattatcctcggttgggtcggcgaaggaacaattgaagagctcttaactgatgctctctcgctgccaagctggtcactaaacaatagtgtcatccatgttataagtgccatcgtgggagttcttcttctaacatattttgaagtggtcttaaccgaaatcgtacctaaaaacatcagtattgatattccaattaagaccctgatgtttgttaccaccccactgcactattttcacattactttttatcctttcgtctggttgctcaatagttctgccaacggaattgtcaaaatgttaggtatgaagccagccgatgagagtcaagacgtcctttcgcaaagtgagattattagcctatctcgaaacgctgtcaaaggtggtgagcttgaacacaatgacttgctatatatggaacgagcctttgactttaacgataaggttgctaaagatattatgatcgatcgcacgcaattaacagttattgatatcaataaaaccgtaaatgacgcgattaaactatatcttaagacgaaatatagccgcttaccggtagttgctgataatgataaggataagattttaggttatgtttttaactatgacttaattcggcaaaaacaaattaacggagatgtatccttagccaaagttctccgccatatgcctactactcctgagactaccccaattaccgaagttcttaagttaatgattagtacccgggtgccgatggtcgtcgttgttgatgagtatgggggtactagcggaattattactgacaaggacatttatgaagaattatttggaacggtgagagacgagatcgacaatgtttcagataacatgatttctaagattggtgaaaatcaataccgggttgatggaaaaacgaccatttatgactttgaacgcttcttccatgttgaacttaaagattctgaagatagcgatgtggttactttgtcaggatatgtgttagataattatcataatattcatgaaggagaaacgatcaaactagccaaccttgatttaaaaattcaagattatcgccattcatatatcgatagctttatcgttactactttatcaaagtaaaattttacattttggcaacaataagaagattatccttttatttaatccttaattctactaaaataattttataatattaaaacaaatctaaactagaaggaagaaattcacatggcaccaatgaatattatttatatttcgcttgagggaaatacccgttccttcttaacgcggatgcagggatatgctaaacaacagcacagtattagcgaagatcgtccacttcttgaattaaaagaagttagcgaccaaactcttcctgccgatgagacagaacccttctttgctttcgtgcccacatatttaaatgggggtaacgggatcgattctggtttcactgaaattatgacaaatgcattaggtgaatacattgcctacaacgataatgccaaacaatgtgtcggcgtagtaggcagtggtaataagaattttaacgagcaatattgcttaaccgctcgtaaatatgcgcgagattttgacgcaccatttcttgcagattatgaattacggggcacttcacaagatattgagcgaatttatactatcttggccaaacggtggagcgaaattaacgcctaacttctaaaataaaagcgacttggattgaattttccaagtcgcttttattttagccttgtttattagcacttatcaaccacgttatcccatacttatccacaatctgtcccattacattatttaggacccaatcaccaaatggtaccgtcacacgttgattgtctgattttgccaaacgattaaacaaatcacgtgctttatcttcctcttcttcaaaatcaagtaaaattgaaattagcgtagatgtttgaggattgcccatcgttgcatctgcacaaataattttttgaccagcaatcataaattcaccacgcattgttgtctggtctaattgatcaactggtaatccaagactttccgcctgctcttttgtcagagcctcgtgatatgtaatttgagcgctgaagtcctgttcataataagccattgcttccttcgcattctcaaatgttaggtatgggtatatagccgtcatagtgttcctccaaaaatattcattgttgattatatattttgaatcgctttccgtcaaactagcttccaattggattagccacttctaaccggatattaatcataacgagggacctattatgatataattgtctagtctattatcaagctaatcttatgatgaaaggatgaattttttggaaaaaattaaaaagcatagcccacttctaattctcggactatttttccttggagtttgtatgcgtatgccgattacagcaataccatctgtcattaaagacattgcacaaacttttaacgttgaaactactagcttaggaattttaacaactattccactcctttgtttcggattactatcatcagtagtttcagcactcgctcaacgaattggtaatgaattaacgattgagttagcaatgattttaatgtttattggttcctatttacgaattttaaatttctcatcgttaatgatcggaacaatattagtcggggctgccatcacttgtattaacgtcttattacctgcaattatttctgataagttgccaaatcgaattggtagtgtaacagggatgtataatgtcgcaatgactttatttgctgcaattggagcttacgcaattactccaattacccacgctactagttggcaaactgctgttatcattattagtatcgttgctttaattgctgtaattatctgggtaccaaacttacgctataatcaacgcgccactaacgaaagcagttctaatgatcgcggaactaacatgtggaaaaatgcaaacgcatggtggttgctcttattcttcggaggacaatgtttcgtcttctatagtatcgttgcctggttgcctacaattgccatggatgccggattaagcagcgataatgcaagtttagttgctggattattacagttattgtcaatgccatttgcctttgcaatccccgtaattgccactaagatgaagaatcggcaaccaattatgctatttgcgggaatcatttctttaattggaactggaatgatgttcttcccagtaaattcccttgtttactatatattcgttgccctatttcttggtgccggtacaactactactttcgttcttgcaatgactttgttcggactaaagaccaagagttccactgatacccgaaacctttctgggatggtccaatcagtaggatatttaatttctgcattaggtcctatcgttgtcgggaacctttattcacaaacacataattggtttgcaagtttaatcgtgattgctattgctgctatcttctttacagtctgtggtgtaatagcagaacgtaaacaatttatttaagataatttttcaaagctgcggaatttttcccagcttttttagttagttttgttttcataagctataattacaaatttcttttaaaagttttttgatctagaccattaattgataagcgcttgccaaaggctaatcaataagccatttatcgatgatggtccatttcaactttctaagagatcttctcagaaaacgtttcctttgatagtgcagattgcgctttaagagtatataattgtcacggtataagaattttctgaaatttcagaaggagtgaacattttggctacagaaaataaggctgtcattacattatttggtgcgactggtgaccttgcaaagcgtaaactttatactgctttgttcaagttatatcaaaagggttacctagctgaccattttgcattactaggaacttcccgtcgtccattaactgacgaagaattccaacaaatcgttcgtgaatctattagtaacattccagaaactgagaatggccaagcagaagcattctcaaagcactttttctacaagtcacatgatgttactaaaccagaacattacgaaatccttaagcaacgccttgctgaattagatgaacaatttggcgctgaaggcaaccgtctcttctacatgtcaatggcaccacaattcttcggtactattgccttgaatttgaagaagcaaggattattaactgacaatggttttaaccgtcttgttattgaaaagccatttggtcgtgactttgaatctgccaagaagcttaacgatgaattatcacaaacatttagtgaaaatcaaattttccggattgaccactaccttggtaaggaaatggttcaaaacattcaagcattacgttttggtaacaccatgattgaatcactctggaataatcgttacattgacaacatccaagtaactttaagtgaaaagcttggggttgaagaacgtgctggttactatgaccaatctggtgcattacgtgatatggtgcaaaaccacatcatgcaaattgttgcccaattagcaatggaacaacctgttgcatttactgatgctgatgttcgagttgaaaagattaaggctcttcgtagtcttcgcctctacacgccatcagaagcagctgctaactttgtccgtggacaatacgatgctggtgatggaactaacgcttaccgtcatgaagatggtgttgatccagaatctggtactgaaacctttgttgctgctaagttaatgtttgataactatcgttggtctggtgtaccattctacgttcgaactggtaagaagttagcagacaagtttactcgtattgatgttgtcttcaagaagccattaatcgatatctttgctaacccacgttctgaaagtgaccaatctcttaactcaaacgtattaactatttttgttgaacctaactcaggttttgcaatccaattaaatgctaagcgcgcgggtcaaggcttcacaacagaacctgttgatttacgcttcttgcaaagtgattctgataagaaggaatctccagaaccatatgaacgtcttttccatgatgcacttgaaggtaaccacacaaactttgcctcatgggctgaaattgcttatgcctggaagttcgtcgatgttatccgtaaactttgggatattgaaaagcctcaattccctaactacactcctggttccatgggtccagcagcttctgacgaactcttggctcgtgatggacgtaagtgggtttatcgtttaaatcattagttactacaagtaatttatagcattcttgctgtaaattacttttttataataaaaattgatgtttagcgtttgcactatctttaatttttgttataatcgaggttgtgaattatattacataagtattgaggagagtgactttaatgtctgatcaaaaagcacaaattggtgttgttggtttagctgttatgggtaagaaccttgcactaaacatcgaaagtcgtggcttcacggttggtgtatacaaccgtcaccgtaaccgtactgacgatatgatgcgtgaccacagcgataagaagttagtacctagctacactgttaaggaatttgtagactcactagaaaagcctcgtcggattcttatgatggttaaggccggtaagccaactgatgctcttatcgacgaattattgccattacttgacaagggtgatgttttaatcgatggtggtaacactaacttccacgatactatggctcgtaacgctaagttagacaagtctggtatcaacttcatcggaatgggtgtttccggtggtgaattaggtgcccttcacggtccttcacttatgccaggtggtcaaaaagaagcttatgacttagttgctccaatccttactaagattgctgctaaggctgaagaagatggcaagccatgtgttgcttacattggaccaaacggtgctggtcactatgttaagatggttcacaacggtatcgaatacggtgatgaagaattaatcgacgaaagttacaacatcatgcgtaacgtattaaagatgcctgttgatgacattgctaagacttttgctgaatggaacaagggtgaattaagcagttaccttgttgacattactgctgatatccttactcgtaaggatgaccttggtgacgacaagagcaagcctattgttgacatgatccttgaccgtggtgctaacaagggtactggtaagtggagttcaatgactgcccttgatggtggtgctcctcaatcagttattacagaagctgtttacgctcgttacatttcaatgatgaaggacgaacgtgtacaagcaagcaaggaattgcctgttgaaactgaagctatttcaatcgatgacaagaaggaaatgattgaaaaagtacgtcaagctctttacttcggtaagcttatgagttacgcacaaggtttcgaacaaatgcggatcgactccgaacgttacgactggaaccttaagtatggtgaattagctcaaatctggcgtgcaggatgcattattcgtgcacaattcttacaaaacattactgatgccttcactaagaacccagacttgaagaacttgcttcttgatgattacttcaaggatattgctaagaagtaccaaaaggcaactcgtgacgttgttgctcttgctgttaaggctggtattcctgttccttcacttagcgctgctattagttactacgactcataccgttcagaagtgcttcctgctaacttgcttcaagctcaacgtgactacttcggtgctcacacttacgaacgtactgaccgtcctggtaacttccactacagctggtacgaagaacaataatcaaataaactttgatttaacgactgagatccattctcggtcgtttttttattttgaatttcttaacaagaaaatagaaatgtggtttgattagcatagaggtgattatcatgaataaaacatttatgagcggctattaccaaggggtcatcgaaacagcccctgctaccctttcagccgctaaaacagaacagttagcaattacaatgacaattctccatttacgccatgccggaataaacattacatcaatccacgattttcttgtcagggatcttcatgcaaatgaacgccttgtaaataaatatattaatttaaatgctgatgagttagaaactattcaagcccaagttatggcaatcgctttcaatcaataattattttgatattacttcctttttcgtaaaactttactaaaattgcattgactttttctatgaaaacgcttactattattcgtgtaagatattatatgttgttgtagaaaaggggagttaacatggatacaaaaattgatactgtaaaaagtaaacagcatgttgcccgttcccgttttgcctattcaatgggagccttcgggcatgatgtcttttatgctttactttcaacgtatttcattatgtatgttactggacacttattcaattctagtaacaaagcattcaacaatcacatggttctatgggttacatcaattatcgctgtattacgaattgtggagttgctagttgacccattaattgggaacgcaattgatcgtactaacacacgttggggtaaatttaagccgtgggttgtcggtggtggaatcatttcagcaattattttagctatcttattcacaccaatgggcggtttaagcctttctaatccttacctatacctattgatctttgctattttatatatcattatggatatcttctattcatttaatgatgttgccttttggtcaatgattcctgcgctatcattcgattcccatgaacgtgataaaatagctacttttgcgcgggttggttctactgttggaggaaatattgttggttttgttattatgccaatggttttattcttctcggcaaatcaaaatggcggtaccggtgatgatcgtggttggtttatttttgccgcaattgccgctgctgttgctgctattactgctgttggtgtcgggcttggtactcatgaagaaaagtcattgcttcgtgaaaacaaagaacaaactaaactaaaagacgtttataaaattcttgtcaaaaatgaccaattattcgctatagctctctcatacctattctatacaacaggaattacattagttaacagtatggagctttactactttacttatattttaggtgattcaagggctttctctattctaggtggattaaacactgttattggtgttatttccgttcttactttccctctctttactggtaaaattagtcggcgtaaattattttacggttcagtttcattacttttcctcggcttattaatctttgcatttgctggtaaatcactcattttagttttagttggtgcagaattattcttcattccacaaccattagtatttttagttgttttaatgactattactgattctgttgaatatggtcaactaaaattaggacatcgtgacgaatcacttacattatcagttcgtccactgctagataagttcgctggtgctgtttctggatggattattggaccaactactattattgctggaatgactgctggtgcgactgcagcaacagttactgctgcaggtgctgctaagtttaagctagtaatgttcctagcccctgctatcttgatcctcattagtatatttatctttgcaaaaaaggttaaacttgatgaaaagatgcacgctaagatcgttgctgaacttgaaaagacttggggagatcaccttgaagatgctgacagcgacaacccacaaacagcatctgtttccaccccacaacctggtgttactgatattacatcaccagttgccggtacacttgttaacttaaaggacgttaacgatgaaaactttgcttctggtaacatgggtaaaggattcgccattaaaccatctgatggtaaagtaatcgctccatttagcggaacagtacgagcaaccttctctactcgtcacgcaatcgggcttgaatccgacaatggtattatgttactgatccacgttggtattgataccgttaagcttcgtggtactggattcattagttactttgataaggatcaacactttgataaaggtgatgaattaatggaattctgggatccagcaatcaagaaagctggacttgatgatactgttatggtaacagttactaacagtaaagacttcgatattaaattattgaaggatgctggtgaaaaggtaactactactgatatcgtcatggaagttactaaaaagtaattaaatatcttctctgttaaaaaaggaactgctctgattcgagcggttccttttattctaaactaggttaaagttacgacattagcaaacgaacactaaatcgtaaaataattctaccaaggaaactcgcttagtaatttcatctgccacgataacacacccttcatttttataaaaaaagagttaatggtattatctaccactaaccctcatcgataatatttaatgactatttaacctgatctacatcagtccgaacaaccagcacatcaacaggcgcattccgctttacgtatgacgtaactgaacccattacggctcgttgtatccgtgataatccactagcaccgataataatcatgtcgttgtggtggtcacgagggaagtcaaacgaaataattgtctttggattaccaagacgaatgtggatatcaagattatcaaagccatccttatccttggcatttttcaacaattcatcaaggtattgctttgatttatcaactaattgataggcaatacttccatctgacataccagcaaagttataagccattgctcgtgtatcgattacatttaaaatatctatatgggcaccattacgctttgcgattgcaattgcgcggtgcaatgcaaattctgattcctgagaaccatcaactggaactaggatgttttgatattcttgatccataggtttgaacctccaaacaaacaagtgatatatttacttaaattataccatttttttgaagaataaagagaaggaaaccagaataatactgacttcagataaaattcaattaattcaaaatttcctaaaatttatactatacattaatctttaattagagtaatcttaatatatccaatatacctttaatacttgaaagtgaggccgcatcttatggacaagatcgataggaagattattaatcttcttcaaaaaaacgcccgtgcttctttgaaagaactctctaaagaatgtttcatttcatcaccagcaattgcggcgcgaatcaataagcttgaacgaaatgggattattactggctaccatacaagtgttaacatggaaaaaattaacttccatgttaaagcttttattcaggtacaacttgagcctcgccaaaagcaagaattttacccttacattcaacaaatccccaacgtgattgaatgtaactgtgtaactggtgattattcagaaattatggaagttgttttcccttctactaccgatttagatgacttcatcaatacgattcaacaacgttttggaaagacaagtacacaaatcgtatttagtacaagcgtggagcaccggggagttaagttagcatcagcaaaagatactgccgattcagaagaagtataaatataaaagcgaaggtgagtacttttcccatcttcgcttttatatttattattcgacttcagcatcagtttctgtcggtgtcttttcttttccgtaattatctaaatatgcattatatttttctcggtcaagggcaccttcagattcaccgataaccagcgtagcgattgaattaccaaccacgtttacggcagttcgtcccatatcaacaaaacgatcaattccggcaatgaaagtcaggccagccatcggaacaccaatcgtggaaacactagcaagcaatacaacaaaggaggcccctggaaccccagccatccccttgctagtaatcattaaaactactaacaacgtgatttggtgagaaagactaaggtggagaccatatgcttgtgctaagaagatcgctgctaatgattgataaattgcagatccatcaaggttaaaagtataaccagttgggataacaaaagctgtaatccccttgcttacccccatctcgtgcgtctttttcatcaagcgaggcaacgtaacttctgaactagcagtagtaaatgccaagacaatctcatcaagaatcgcgcgcatcgtcttccaataacgtaaatggaaaatgtgagcagtaataccgaggacaacgataataaaaattagcattgtcacatacgcgattaaaataaacaatcctaatggcaacagagcgctaatacccatttcggcgattgtcattccaattaaaccaaagaccccaattggcgcaaacttcatgacccaattagtaactttgaacataacttctgaaactgcatttaatacattaattaaaattttagccttttccccaacagctgcaatccctaatccaaagagaacagagaacaggataacaggcatcatgtcaccatcagacatggatttaaaaatattcgttggaataatcgacaaaattaatggccaaaatccgctattatgttctgcggattttgcggtggacatatattgcgaaatatcagttgcatgaagtttatgaatatcaataaacgaccccggatgagtaatgttagccattacgatccctaaaatcaacgcaatcgtggttaaaacttcaaaataaattaatgtttttccaccaatccgacctaactttttaatatcaccaatattagcaattccgacagtcaagcaagaaacaacaattggcattacgatcatttgaatcagccggataaagattgttcctaagctctgcataacagtgatggcactcttattttgatagaaaattaatccacaaataataccaagggccagcccaatcataatttgccagcccatactgaggcgcccgaaacgatatcgcttcactttatatcaatctcccttatgtagtcttattatactttagcacatttttagtaagattttagcaatttttaagattttatttaattaaatccgaacactttttgctctcttcaggtattttattcacttcaatataataatcctaatttataattcgtaattttcactaaagaaaaataagaccgctactaagtatttctctaatatgatagagtgtttagagaatatttaattgaacaggagtaatttatgaacgcttggataacggaatttattaatcagtttggttattttgcaattgccttactaattgcccttgaaaatgtctttccaccgctaccatccgaaattatccttacaatgagcggattcatgacgaccaccacttcattatcaattattggtgtaattatcgccgcaacaattggttcgcttatcggggcacttatcttatatgcccttggtcgccagttaactgttaaacgtctcgaacgtcttcttagtcatcgcttatttaaacttctaggctttcatcaagatgatgctaaaaaagcagtcgattggtttaataaacatgggacaggtggcattctctatggccgctgcattcccgttatccgcagtttaatctctattcctgctgggatcgcgcaaacttcattagggaaattctgccttctcactacgatcggaagcgcaatttggaatacactgcttgtcgttctcggcgcttgggtcggccaatcgtggaataaaattgtcataatctttaatgattatacaaccgttgctatcatcattatggcgatcgttggtttatactttgcttatcggtggtatcaaaaaagaataaaaaaacctaaatttcaagaataagttagccactggactcaaataaataatactgaccaattgattattggttgatggagctgtgatatctcttggtagaaggccttacgatagatatccattgacgaatgtccattaaacatagctcgtggatagtgattcatccaatcattagttgctatgatctgagcactactatagttatttatagcttcacctttggtaatttccttgcggagaaaccggttattgatctcattggatccacgttcccaaggggaatacggatcagcatagaaaacatgatcgtgaacttgtgttaactcactaaattctgaactgttgtcagaggttattgtcttaaagatgcgatagtaagcatctgtgcccattttctggcgtaaatttataaagaactgatttactgcatgcgcagttttaccagcaattttactcgtgatattaactcgtgaagggcgatcagtcattactagtacaacactgtcattaccgtttttctgtccctgaactgtatctagttcccaatggccaatttcggaccgttggtccgcagtttaaggtcgttgagcaatattaggccctaagcaccttttagcttgcggatgagttcgatgatgcttacgtttaggtttttcaaagaggtctaaattggacgtacgaagcacaccctcattaatccattgatataaagttacaaccgactttgggatcagggtgccatcattcattaaatctcgagccttataaataaccgcttgtggggagtaatggtggtcgtcaaactcaccaagcattagctgatcagctaatcgtaaaaattgctttgaagaataatataagcgacgacgaccagaatggcggtgatgttcaagatatgtggcctgaccagcttcataactatagatgtagtaagaatattcgtaaatcttaccattagatttttgacgacgaagttggcggaccgtaccacggttgagctcgttattaactgtttgatgattaactcctaattggcgaccaattgcgcgattggaaagtccttgcgactttaaagtcgcaatcatcacacgttcttctttagtaaaatgagcattctttttatgagtagtcaataaactagtagacatggtatcatttaagtacgtcatttgacggacatccgttcatataggtttggttcacttaatatgatacctgatgtcacgccgagtggcgttttttatttaccaccaactgggtggctaacttcattctataatccaccagaataaaaaaataaaatgattcagtttttattggtaaagggttctagcaccattactattaaaactgaatcatttttatatgctatcgggttgtttgccgtttgatcaagtgagttccgacaactgtcttacatggatcattattgggattctgcagccgtttaatcatcatatcaactgcggcatgcgccatttcatcagtggcaacatgtactgttgacatacttggataaacatacttaactattgccgtatcgttaaaactaatcagagcgattcgattcggaacgttaattttggcttcttgaatcgctttaagcgcgccaactgccatcggatcatttgctacaaagattccatgcggcatacggtcaccaagcgtcgcaattgcctttttcatcgcgttatatcctgacatcgaggtgtagttgccagcaaatataaattctggatgataaaggttttgttgacgtaagttactttcaaaatagaatcgccgcaaatcaggaacaatttgttggtccgttgtcttttcagttcctgccaacataccaatatcgttaattccttcgctaacaaattctgaaataactgaccgcactgcattttcaaagtccggtactaagcaatcgtaaccggcagccaaactatcgtaatcaacaaacacaatattagaagttactaaccgcaatgcttgaacttgcgaatcactaaattttccaatcgcgatgatgcccgtaacatcgcgaggaatttcttccatattattttgataaaccggaaccgtctgtagtccctgttgttgagctgctcgttcgattcccatccgaatcgccatgtaatacaaatcatccaattcctgcgtaagagaataccattgaacaacagctactcgttgtacttggttattgcgtgctcgcttatgcttagtatagttaaactcttcggcagtggctaacactcgctgacgtgtcttttcatttacagaaagcgtcacatcattatttaaaattcgcgatacagtcgcaatagagacccctgctttatccgcgatatcatgtaatgttactgccatactgcttcagcgcccctttcttcattttaggttaaaactattttaaggcatcaacgaatcgttgccaaccttcatttccagctgcatcatccttaaagactcccgcattttctagaacattggcaaagacattagcaagctcttgttccataacctcatcgacattatccgcggtgatattaatccctgactgaacttcttttgcccatggaagatgactatctgcaatcttattttcagcaccaagccaaaacttcttaacttcatttaattcatctttgagccgcgctggtaaaattgctcggcccatcacttcaatcaaaccaatattttcctttttaatgtgccatagtttttcatgggggtggaagattccaagcggatattcatcattagtattattatcccgcaaaactaaatcaagaacaaacttatcgtcctcccgatgtatgataggggtaacagtatggtgccgcgtctgtccatcaaaagctttaatgccaagactttcatcactatattgatcccataccttaataatatgtgtaccaagatctattagttgctcagtatctgtactagttaaacgaatatcgctcattggccagttaacaattcccgcatcaacagctggatattcagcaaagtgtaattctttcttaatggaggctttcatcattgggaaaatatgcttcccaccttgatagtgctcatgagcaagcatcgaaccaccaacaattggtaaatcagcattacttccaacaaaatagtctgggaattgcttttcgatttcaaccaagttaattaaagtttgccgattgatcttcattggttcgtgcttactatcgaggaagatacagtgttcgtggaagtaagcatatggtgaatactggaatccccattgttgtccacctactgttatccgaataatacggtggttgcttcgtgctgcttgtccaaggcgtcccctgtaaccctcattttccatgcaaagggcacattgtgggtacttcttggcggtatcatgagcagctgctgcaattgctttgggatccttttccggctttgaaagattgatggtaatttcaagattgccgtacttagttggtttatcaaagacaacattctttttgatagcagctactttaacatagtcgttgctggtacataggttatagaaccaatcagtcgcggttgatggagattgttggtacttttcccagaacttatgattgactactgatggcgttggggtcatcaagtcataaagctgatcgtttaaaatttctttagcagtttgaccatcatcaattttgccgcgtttaacagctagatcaacgagttggttaacaactggttcatcatctttagcttcaacatcttcatcaccaacaaagccccgaatcttgtttaaaacatagattcggtcgagtggttcataagttccactagcaatcacttggtcagcaaacttttccattaacttcattttctcattcccccactaaaatactattaaagcttatgtggtccatcaacaacttcagcatcatagaaactggcatcgtaaccaatcttgtcccggtagatctttccaacattctttttgaagttttctgcttctgacttcttaacaatggcaatcgcactgccggcaaatccaccgccgaccattcgagcaccaaggcagcctggttgattccatgcgttttctgctaaggtgtcaagctctttaccagtcacttcataatcatatttaagtgatacatgagaagcattgatcagacggcctaattcttcaagatcgcccttttccattgcatcaatggctttctttgtccgttcattttcactaactgcatgacgggcacgacgaatcagtgtgtcatcatcaattaagtaagtgtattgatcaaatgtatcggagtctaattccccaagtttgttaatatcaagcttcttgttaagacgtttaactgcttcttcgcattcttggacccgttcgttgtatttggaaccagctaaggagtggttcttattagtactcatgataatgatttcataatcgccaagttcaagcggcagatacttatattcaagagtgttgcagtcaagataaattgcgttattttctttacccattccgacagcaaattggtccatgattccggaattaagaccaacgaaatcattttcagtcttttggccaagtttaactaattcaatttcatcaatatcaagattaaattcatccttcaagatatttcccatcaacatttcaattgatgctgatgacgataagcctgaaccataaggaagaaaaccgtggatgtataagttaaatccgtgatcaatcttgaagccccgttgctttagataaaccaacatccccttaaagtagttaacccacttttcatctttagcattttgcggttctgtatcattaatgtcaaaagtaataatcttactatcttcttcttttgccgaattagctgagtaaatggctactgttgtatcttcacgcggaccatataccccataggttccaatactgatcgcacatggaaaaacatggccgccattataatcagtatgttccccgattacattaattcggcctggtgaaaagaatacatccttacccggttctttaaacacgtcttggtattcagctaaaaattgttgcttatccatcagcataacctccatacatcaaacaaacattagtaaacttttactaaatacaatttactactttttaaccacctcgtcaataagcgcttacaaataattcagcgcaacaaagaaaacgattacacagagccagagttgatatacacgatccatcttttaatgctacactagttataaataattggaggattcaaatgaagaaatatcaaccaaccgatctaattaaatttgcttcacgtactggacgctggaccgttaaaaagattaataatatgcccaccttatacaccactaaccttggcagctaccttcgttttaaggtttcaaatgctaaaaaatgtcaaatttctgttttgccaaatcaaaattccctatctcctagccaagtgtttgcttttcgaattgatggcggaaagtggcaacgggcacaagctagcttagaaaaaattgatattccacttgattcgacattacatactatcgaaataatggcagccggtaataccgatattgacgaagtatggcaaggtaatgaaggctttgcaattaaaaatatttatctcgataccggcgaaattatggcagccccgcagcgtcctgtggtcaactttatcggtgattcaatcacagccggttgttgggtagttggcaatcaccctgccgttgactaccgaccagaaactaactatgcgggaatctgtgcagacctgcttgacgtcgatagtgttcgaatagcctactctgctggaggagtgctaagatctgctactggcggggtaccaactgccgatgcctttttaggaaaaattgatgctcaaacatcatggacgcctaatcatcctgatctcaatgtgattaatttaggtgttaatgaccgtcgattccccctagctcaatttattgccgctttcgatctttttatccaacaagttaagctaacctttccccattctcctttagctattatgattccttttagtcagacttttgcttctgaaattcgaaaaatcgctactaaacatgcctgttcgataattgaaaccaaaacttggcaccatagtttcactgatgggctccatcctgatcaagcgggcgctattactgaaggaaaaatgcttgcacaagctttacaaccgcttttacctcaattcagtgtacaatagtagtaagagttaatacgaggaggattctcatggctaaccaacgcttacttccaataaagaatggctataattttcgtgatcttggaggttatcccacagcagatgggcatcaaatcaaatggcatcggcttattcgtacaggctcacttgctcgtttagatcaaactgatctcactgttttagataatattcctatttctctagatatcgacctccgcgctcccgatgaagtaaagaaagaccctgatcgagtgccttcccaagcaaagtattatcatttacctgtttttgaagccgatgaaacagatgcctcgcatagtgatgaagaaatcgccgcgcagatgcaacagccaggaaacggttatcaccatatgattgatgtttatcaccgaatgaccacggctgcttcagccaagcaagcttaccagaaattatttaatctcttattgaataatgaacatggtgccttgttatttcattgtactgctggtaaagatcggacagggatggctgcttatcttatcctcagtgccctcggggttgagcaaaagattattatggaagattacctgctaacgaatactgttactcaagagtttcgtaatcactggttgcaagacatgcgtaatcacggcgctagcgaggcactagtgacaaaccgggcagcccttgcctcagtagctcctgattacctaaatacagcaatcaaaagcattacccaaaattacggaaacgttaatcaatatcttaataattaccttgatattacgcctaccgaaataaaagatttacgaaaattgtatttagattaggctcgattataatatgtcttataaggaggaatttttatgcaaatctcagtaccattaattaatgggatgttagcagatgaatatggtaaatatgcgccagcagctgatatgctagctgaccatccaatcaagtcatttccaattaaaattaccgacgcaccagcagatacaaagacatttgcactcgtctttattgattatgactcaacacctgtctgtggttttacttggatccactggttagccgccaacattccagcaacgttaacagatatccctgcaaatgctagtcgagaattagcagacaaatttgttcaaggaaataatagcaatgccggctcgttggttaatggaaacccattgattactagtggttatgtgggtccacaacctcccgacaaaattcacgattatactttaatggtgtttgcgttagacgatactctacccttaaaaaataaatactggcttaatgacttcatccacgcagccaagggtcatattctagcaaaagcacaaattgatttgccaagtcgtgcatgaggaggaacttataatggaaacaagaattttctttaatccaggcgattcagtcgctaatattcatgactataatgaagctgttcggaagggacaaatttttaaacaagcacgtcataatgacgaacttgtcatcgctaaagatcctaacgataaagaatacgcaattttttacgctaaggatgccttaccagctgaacacgaaaaatcaaagccctacgaaattaaaaatcgtctttaaaatagaaaatgaggttggaaaaataatccagcctctttactagtttaaagtataacctgccaaaacgcagtagctggctggattctgaacgttgataaatcaacgtccagaacacctagccatccttgcgggggtgggactaaaaactcgcaagcgagtttagtcccactcccattttctatttcgataaaaatcttaacgaccaccaacaattttggctgtcgcattttcaagccgttcaattaatgaatcagcatcgttcttaaagtcatcaacaaatgagcttgattgtggttgaatgcgtcctacttcatcacccataatatccgtaacgactaggtcatccccatcccacttcacatcatcgtaatgaccttcaagggcttcatcaaaaaatgcttggagtatatcccgaacagcattttgaataacagccttttcgtcaacttgctcaccacgtacttgatgttgagccagctgcattgctacttcttccatattttctggaatttcaacgctcattatggattcctcctctaaaaaaattaatggcgacgtaatttccgccgagcctttttactaaacttgattccttgaagggacttctttttccgctttaattgtgaatcaacttggttatcactacgcttagccacttgttgcttttgttgcatttcgcgctgacgcttgagcagacgcttacgttcatattcaccccatggattcaataggccacgcataaagtcagcaacttcctgcttatggtcatccatccacgcttcggccacatctacatcatcagtatcgataccattactattgatgaatgataaaactaattgggtttcccgctcatcacgatttaatgaggcaagcatgtcttctgatggttgcatattagcaattgcctttaagcccaacttgtattgatccatgttgatataatcattttgcttcaagtattcaaacaaggcctgcgcgctcggtacgatgttgtgaatctgcttaattgaaatatgtggatctaatggcatcatcatgcctaatacgcgttgcaagttgctgaaagtccattgacctggatattcattacattcttgaaccattaattccaagaactcttgcacaacatagttcaactcaacatcatctaattcaagattattgaattgggaagccgacttaatagcttgttgcacgtttgctaataaatccttgaacttctccggtgtccatgtaatttcttttttagcaggacttgcttgaaccggggttgcttctgcttcgtcattttccgcatccccatgtaattgtgcccatgtcttatgtgctttccgacactcgttcatctttgcccgttgttcttccattgcttttacaacttccgcaagattttcaactttcaaaaattcttgataagctcgcaaaactggaacaaccgcaattccaaattgattagttagtgctggatcagcgatgaattccccgaccatgaccgcttttactgcttctggtgtccaagtagtatcggtcaaatgctgatcatttgccatctggttattaaaacgcgtcaaaatatcctgtgcatgcttttgctgattagcagataactgatgatagttggacgaagtaagaaactggtcaatatgttgttcttgttcgttcattatctatatatcctccgtctccaaattgaattttcctttctatcatatcataattatatctagtaaatataacaagattgctaatgtacaaggagaaactataccaatgcaacgaaaaaagatccaggaagcaatgaaaaatgtctattttcaaaaaatgactgcaaatggctatcatgaaattgaagaacaaattgcaaaattacaacagcaaagacccgcaaaaattgaacaattaaaagcagcccgtgcgcttggtgacttatctgaaaatacagaatatagtactgctaagcgtgaattacgtcaccttgagagtaggcttcggtaccttaataaacaacttcagtatgctgaaattgtgacccccaagaatgatcacactattgatttagggacaaccgtgacaattgaatttgaagatgaccatgaacaagaaacttatcatattgtgggaaagcaggaagctgatcttgccaaacaaaaaatctcctttgattctccccttggtcaagccattcttcaccaaacagctgggaccactgtaaccgttgaagcgccgcaatcttcatataaagttaaaattgttaaagttgaattatagtgttgataagtcattcgatgttccgtaatcggctaaaggaaatttttaaatttattattttcaacgatagggttaatttcccgccctttaattaatctaagcgactgattaaataaacttttgggtattgcatccctgattttgactcggtatactattaaacgttgctttttttgcatccacaatatcttgtgttactagccggcagtaaccacaaaattgcacaacatatagtagagggagttatattaatgattagcgattattttaaatttcttgcccaccaattaaagggctggccacaacaaaattattacctattctttttcagtcttggatgccaggtaatgactttagttagtgctccaataacgtgggtaactgtcattacatttattggaaccacgcttggggtactttgcgttttagcaattaatgctgctaagtcggtaaatggtttcttaggtattttatcagcattatgtttcatcattgctggttttagtgctaaaaattatttaagtattgccgaacaaatcgcctatgttattaccctcgatttaccagtattactttccgcaaactggaatgttaacatggcatcaaagatccgtaaattcaatgctcgttcatggacggttgccatcattgcaacaattattgtctatttcgtttctggttatttaatcggtcatcttactgacgatccacgaccatggattgatgcaatcagcttttccatcagtctgtccgctggtgttatttgcttcttacgttttaacaaccaatatttctggtggcttgcatctggtcttgcgcaactagtactctggtttgtttcttacaagcaaggatctgccactttagcaatggccgttaacagctcaatttaccttattaatgatgttctcgcctttaccatttcaccatggtacaacgaacgtgaacgtcaacgtctcagtaaggaagaagcagcctatgccaaagaattgggcttagaataaatctaaaaacaggactgtgacataagttaagttactttcataaaaagcaaatacgcagtacaacaatggcctctaacgtccggtaacaccgaacgttagaggcctattgttgcttgcgggggctcccagaggctagcttcgcgtcgaaaaacgaagtcacgagtgacttctgtctcgctccctgtttttgtgtttaatattgtttattgtattcataaactaattctggttcacgaccagtacgatgataagcatttaatgcatctatctgtgccatttcttgggcgttaagttcaaaatcgtaaatatcagcgttttgggcaattcgctcttcatgaactgacttgggaataaaagaaacaccattctggaaatgccaccgcagtataatttgcgcgatggatttattatgagcagcagcaatatcttttaatactggttcattgagaactgctcctcgccctaatggactccaggcttgcgttactatttgatgttgacgattaaattctaatagtggtttttgtgttaatagcggatgcaactcaatttgatcaacaaccggcatttcatttgcttgggttgctaaatattgaagatgaatcatttggtagttgcttacaccaattgacctagtaagtccttcttttttcatttcttcaaaagctcgccaggtatcaaaaaatgatcgttcaattggccagtgaacaagtaacaaatcaacgtaatccatttgtaatttatgtaaggattctttgacagattcaatggccgtatcgtaaccttgattttcttctgccactttagttgttacaaaaatattatcgcgtggaatggccaattgcttaaaagccatccccacttcttgctcatttccgtataactgagccgtatcaaaaagccggtacccatcttcgtatgcctttttgactgcttgattcattgtcgcttggccatctaccttataaaggccaaaaccttcttgaggcatttcgtttccatcggcaagggttaataggttgtccttaatatccattaaaaatcacgtcctttccttatctttaatcagtaactgaggattgtcaatatcgaaattttcctttctgaacaaactaatgtatgatgagtttaaatctatttacggggaaacaattatggctaaaatatttatcgttgaagataatcctgatattattcattccacaactcaagaattaaataaatggcaacacgatgtcatcacagttaacaactggcaaaacattgcaaatgaaattcttgctacaaacccagatctggtcttatttgatattacccttccaacgttcgatggcttttattggattcaagaggttcgcaaacatagtcaagtgccgattatagttatttctgcagctgaaattgataccaatgtcatgcatgcagtggccgcgggtgcagatgattatattatgaagccatttgcgatgacagtgcttttagctaaaattcaagctttgttacggcgaaataagcagacggctgatgcagaagaaataatgtgggatcataattcattcaatccccttactaatattcttacaaacgaaaacggtactgcccagctcactccaactgaaggctctatgctccaagttttactcagtcaccgtaataaaaccgtttctaaggagcaattacttcaatggttatggcaaggtggcaaataccttaatgagaacacccttaacgttaatattagtcggttaagaactaagctaagcacaattggtttacggcaatgtattcacacagaacgtggccttggctatcgattggtggaaaacaatgaataaacgttatttcaaattattctggcgctcaatcctttttcctactattggatatctttttctcttagggctgattgggcttttagtaatcttatataatctcccaactgttttttggggcgatgtgattcgcttttctcttcccttttttatagtgtggcttatcggtagtggtgcaattaaatattatcgattgcgccatttaaatatttctcagctcgataaattcactcctaccaatatgactgagggaaaacttgttgaactattgcaagatgaacaagcaaaaaacattgacacaatccgtcagttacaagcaactcaacacgaacagcttgaccaccttgaattatttactcatgaaattaaaaactatttaacaagtcttaatgccgcggcagaaaattcaccaactgtcgcaagtccagaagtaaaaaagaatatccaccaagctaactattatctcaatttgttgttaaatgacgaacgactagcaattaataatcatgattacgattttcaatggattgatattgccaacttaatcaataatattttgcaacaaaattctgcggccttcattcataaacaattgattccagaattaaccggcttggacggaattaaggttctcactgatcgtaaatggttgctgttctgcattgaacaactactttcaaatgcaattaaatactcagctcctaatagtacaatcaatatttcctgggaaatgaattctttgcggatcgctgaccatggatgcggtatctcaatgaatgatcttccgcgaatctttgataatggttttaccgggaaaaacgggcaccaaacaactgctgctactgggatgggactgtaccttgttaaaaaagtcactgagcacttaaatttcaaggttagcatctcatcagttcaatctaagggaacaacagctattctatctttcttaccagataatatcagatcatcaaactaattcttacaaaactgtaaggttctgtacacttccgtaagtaggaagttgcacagaacctttttataattaagacataatcaaaattagttctctaccagaaaggaaaattactatgacattattaaaccttcaacacgttcaacgcgtctataatcctaactccgctaatccagtaatggccttaaaagatattacctttaaagttgaagagggggagtatgttgcaattatgggagaatctggtgctggtaaaagtaccttattaaatataattgcaaccttagaacaagcaaccaacggacaggcaatccttaatggtcaagatctccggcagctttccaaagacgatgcagctcgttatcggcgggaacacctcggctttgttttccagcatttcaacttacttgatagtctctcaaatcgcgacaacgtctacttaccacttgttctagcaaaagctccggtagcaacaatggaagaacggatcaagcccttaattgatcgcttacgtattaataaaattattgatcgttttcccagtgaaatttctggaggccagcaacagcgaattgcgattgcacgggcgttaattacccacccagacctccttctcgcagacgaacctactggagctttagattcaaacaccagtaacgaaattcttgaactctttgatgaagttaatgctaacggtcaaacaattattatggttacgcacagtgccgctgctgctagtcatgctaaacgcacactcttcattaaggatggtcgaatctatcatgaactctatcgtggtgacctttcacttaaagactaccaacaacaaattagtcagacaatgatgaccttaacgaatggcggtgaataatgatgctctttttcaaactgattaattcaagttttaagcgtaatcttaaagcttacatcccttacctcatatcaatgacaatgctagtcgccattaactatatttttaaggcagttgaaattaatcgcagccttaaagatttaccaagcgcggcagttactaaagcattaatgcaaacagggtcaacttttattatcctggtaacacttgcgtttatgatctacgtcaatcgtttcttatggcaacagcgtcaacaagaaatgggcctttatagtatgctggggatgacgagacgtaacttacaagtgctaacagtcattgaaaagtgctatcttttagtaattagcctttttctcgggactttatttgggattatttttgatcgactcgcttttcttggctttgctcatctcttgcaaatcgatcatttatctcaaccttggattgaatggggcgcggtgataaatacaatcgtcatcattggcggctttttcttaattttaatggtcattgatctgatcaaactattccggctaaatccaaacgaattatggcatccccaacaaactaaaatcgcgcgtcatggtaagttctttacttttgccggtcttttgggtgttgcagtccttgcctacgcctattatcttacaattacagttaaaccgcggatgtctgctttaacaacattcatgactgcggtcttcttagttgtgattggaacgtacctcatttttattgctggtagcattattgtccttaaactcctgcaaaaaaataaaggatattactatcgccctcgccactttatcgcggtttccggaatgttacaacggatggaacaaaatggcgctagtcttgcaacgatttgtttactctgtagctctgtccttgtaattttatttacatctttaactatgtatgccggcattaatgatacggtcaattcttatgccccacgcgaccttacaattatcacctcgcagaaacttactgcacaacaagaatcgaccatcaattctgttgccaaaaaacaccatgctcaacttaataagcctgttacctttacaacgagcgctccgcaatacggctactgggaaaataatcatttcatcaaccagggtgatttacaggatatgactaatcaaactaccaatacggtcattaccatgtcgacagcaacttataatcggattgcggataaacatgttaaattagcagcaaataaggctttgatttattcccctgctaaagaacatcgtggtactttacagattggttcgcaaaaataccaagctactcctatccatgactttaactactactttaatccaagtcacgctatttattcaccaatttttataatcacaaataaacttccggcaaacactaccacaattaacttcacaggaattaattatcgcttaaacggcagtaagaaagctcatcttaactttgaaaatgatcttcaagcccagcttcacttgccaaaccaagcatattcttcccggacaaaccttcgtagtcaattgaccagtctctatggcggaatcgtctttttaggaattctcattagctttgccctaggaatcacgacaactgttgtaatttactttaaacaaattactgagggttatgaagatcaatatcgctttaagactatgcagcaagttggtttaagtgagaaagaaacaaccaagagtattcatagtcaagtattgatggtcttcatgttgccagtagttggtgcaataattaatctttgctttgcgattcctgcaattcgacaaattctaattcaatttaatttctataatgttcgattgatggcgataatagccgtatcaatcactcttgtcctcctatgcctttactttgctatttatggacttactaccagaatgtaccgaaaaatcgttgcacaaggttaaatactataaattgacatttcttattttaacggttacactttaattactataaataagtacggccgataaatgaggagatgtcgttcatgattcttattaacaccaccatcatagaaaaacttacaagctgttgctaaactactcacgacagattagactgcccttatttaggcgtgattaatctatgttattgtttagtgacagtttttagtttgatttaaattatatcgaggtgatttcatgacggccgatccattaagaataggaattcttaacttaatgcatgacaaagtagatactcaactgcgatttacaaaagtactttctgagggaccctacaatgttgatgtacaatacttttaccctcaaacacactatacttctcgccctgtccctgaccttgttcaaaagatttcccaacctttagatttaaaacaagttgccacaatggatgcttttattatcaccggcgccccaatcgaacaacttacatttgaagaaattacgtatcttgatgagattcatcaactgattgacgtattagttgccaataatattccgcaactttacgtgtgctggggagcgatggcggcggctaactacctttatgatattcccaaatttcaattacctgaaaaaatttttggagtcttccacaattatttgcgcgcgcaagaccccctcttaaaaggattacctgatgggtttcttgctccccatgctcgttatgccgaactcgatattgacaagattatggaagattcacgattagttattaatgctgtgaccaaaaataacttcttattctcgttccgcgctcgagaaaagaaccaatactttcttttctcccatcttgaatacggaaaggatgcccttttaaaggaatacttacgagaacggaatgctaatcccggcgttgagtatattaagccgcaaaactactttcgcgatccgcttcatatgaaagatcccgaattcagctgggaaactacccaacgagtgttctttgataattggcttcattcagttgcggaccacatagctacacaacaatttgtaaaggagtaattaatatgacgaaaatcacaaattcaatcgtaaatttaatcggtaacactccgattgttaagttaaatcgcgttgttcctgaagatgcagcagacgtctatgtaaaacttgaattctttaatcctggtggttcaattaaggatcggattgcccttgccatgattgaagaagctgaaaaagctggtaaattacaagcaggtggcaccattgtcgaaccaacctctggaaacactggggttggtttagcaatggttgccgctgccaagggataccatcttgtcatcaccatgccagaaacaatgagtgttgaacgccggaaactcatgcaaggttatggagccgaacttattcttactcccggtgccgacggaatgaagggtgcaattgcaaaagcagaagaactcgttaaagaaaaaggctactttatgccaatgcaatttgacaatccagcaaatccagcaattcacgaaaaaactacaggaaaagaaattcttgacgcatttggcgatgatattcctgacgcatttgttgctggggttggtactggaggaacacttactggggttggtcatgcattgaaaaaagctaatcctaatgttcaggtttatgctcttgaaccagcagaatctccagtattaaaagaaggaaaaggtggcaagcacaaaattcaagggatcagtgctggctttatcccgaaagttcttgataatgatgtttatgacggaatcctcgaagttaagagtgatgacgcaattgcgatggcacgtgaagtcggtcatcaagaaggaattcttgttggtatctcagctggtgctaatatcaaaggtgcgattgaagttgccaaaaagcttggtaagggtaagcaagttattactgttgctcctgatggcggtgaccgttacctttcaacagaattatttaattactaaaaattaaaaaggaaagagactaagatatttttaatctctttccttttttctattgaccgcgaccttacgtcattagctacacttaataatttgatgacttctgatcaatgtaatgtttcactacagtgtaataagcactgttatattgaagaatattattaatgaaaaatgaccaagagcacataaaattctgcttcttggtcatttttcgattctttataaaattggtgaaagtaagcgagaaaagtattgcttgaatttccgccactttgattgattagcaaaatactcaggagtaagtaaagtactctttttcatatcattttcaaagtctttctttaactgcgctgttagtttttcattgtacgcaaatgcattgacttcaaaattaagtctaaaactacggtaatccatatttgccgaaccaacagaagcaatgttgctcccactaaccatcgtctttgaatgaataaagccattatcgtacttgtaaacttttaccccattgttcactaagtatttagcataatattccgttgcccgataaacaaatggatgatcaggcatgcatgggatcataattcggacgtcaattccacttcttgcggcaattactaatgcttccagcactgaatcttctggaataaggtatggtgattgaatataaacatattttcgcgctgagctaataattgattcatatccccgtcgaatcgaataattttcattatccggtccagaagatacgatttgcattggaacctcatctggatcgccatctggtgcaaccagttcaaaattcttaaattctttttcaaggtcaattttctttttatgagttttccgacaagttgtattccagtccatcgcaaaccgcaccgtcatcatcatcgttgcttgtccgacgacacgaagatgggtatcacgccaataaccaaacttcggatcttcgccaaggtattgatcaccgatattgaatccaccaatataaccaatcttgccatcgataatagctagtttacggtgaagatggtagtttaaccgtggcgtttgaaaataagctttggcagcggcaataaatgcttgcgcttctccacccaactcttctaaatgcttaaaaaatttgaaagtagttccatgagacccacttaagtcatagagaacgcggacttttactcctcgggcagctgcatcttctaaggctgccaacacccgcttccctagattatcagcataaaaggaatagtattcaatatatacatgatcagttgcatgatttatatcatcaattaacttatcaaacttctttttcccatcaataaatacgtgaactttattattaaaggttactactgaatcattcaaactcaaaaaaaggttaaccaactggcgatcgcgtgacaaccggctcccttttggcattaactcatgctcttcacttagctttcgttgcttttcaagatatttggtccgtaattgtttttgctcatcttgaatactaaatatctcatcatgggataattgtcgtcccacaaaaagatataggataaatccaactactggcaaaatagttaagactaatagccaagcccaagttgatgcaatatcccgacgactacgaaaaacggtccatactgcaaaagcaatgttaattaaccataggacttcaataatgcggcgaacaacatcccatgtccaaacaatatccataatttaataatctccctagtagtattactgattcattatagccattatttgcttacttttcagcaggttcagagattattttcgataaaaacgacgaagggcaaaagataagccgatcgctaaaagtccgtacactgcacctacatagccaagcatcgttaaattagcaaagttaacagtcgtcgaagcagtgaaggatccaagtgaaattccaacattagcgaaaatcgaaattaatgatgttgctaaagctaatgactgcggatattctttttctgccacactaataaataccagttggatagttgttccatatataattacaacgacacaaagagctgctagaacaagcattcctgtaatcttatttcctaatgcaatcccaagaacaagacttaagattgtcatgagaataaagacaatcggcagtttctgaaccccattgtgactcgcaacgattccagcaatttcgttaccaataatactcattacccctaaaagaagcagcaaccaatttagactagttaagctaaagcccatcacagtagtaattagcggccgaacataagtatagaaagtatactggaggcttaaaacagccaccgtgattccaattcctaataaaacacggtgatcttttaataacgctaactgttctaaaatgctccctttaacttgaggtgtatcacgaggagtaagccaggctaacaacgcaaacacaattaatgttaatcccgaaatgatccaaaaactatcatgccaggaaagtaacgttgcgatggttgtaccaagaggaaccccaatgaccgacgcaatactaaaacctgcgccgacccacgctagaaccattggccgcttgtccattggggtaattatactaactagcaagttaattaatgaaataatggttccagcaacagcggcagtaataattcgcgcaaataggagccagccaagtgttggtgccatcgcagttaaagtattaccaataaaaaagacggtcattaatagcataagaagcttatagcgattccaattgctagttaaggtagtaataattggcgtactaatcgcatagactcctgcaaaagctgtcaccaaaaaaccaactgtggaaagtggaacatgataactccgtgcaatatctgataaaacgcccacaaccataaactcattacatcccagcataaatgcaacaagaataaaagtgaacgatcgcaatttagcgtgcttcacaataaacctcctttttaaaacaaaaaattttctggaaaaagtcaatccagaaaattataaacgtttaacaattaatttccaatagttttgaactatttagcttaataaagttgtgattgataagcagcaaaggttttatcatcaaagcaaaccatcgttacttgatcaacacaattggcagtagggagaaaatctttaattgttttaatcgcaatttttgctgccctttcaagcgggaaagcatatacccctgtactgattgaagtaaaggcaaccgtccgacataaatgtttatcagccaacagcaaactattgtgataagaattggctaacaattgatcttcaccattatcaccaccatgccaaattggtccaggcgtgtgaataatgaatttggctggcaagttaaaaccgccagttatccgtgcttctccagttggacatccatgaaatttttcacaggcaccatataacgctgggccagctgctcgatgaatcgcaccatctacacctccgccacccattaaagttgtattagcggcattaacgattgcatcaacttttattttggtaatatctcctttgattgcgctaattactgacaataaaatcaaccctttcgctttttaaactgtggatatagccagacagtgcaagttaaacataatgctaccaatatatttcctgttaatgcaccacagatatatccaattccattgtcatttattggaacattgattggaaatgttaaccttacttctaataatgttattatcagccacgttatccaaaatccaggcttattttttattttagaccaatcagcataactgactaatattataagactagaaacaataataaaagaaataatcgtaaatagcggttttggtaagtaattacttaaaaaaggtaaaattggttttaatactataactacagcgccaataatattcaaaaaataacaaagaacaaaaattttatctactcgtttattcatagtgtgctcttctttatagttatttatcatctcatgatcctcccgtaataaatcatccaaactaacatggtagagatcacttatttgaaccaacataaaaatatcaggataactccgaccattttcccaactagaaattgttttacgcgagatcaataatcgttctgcgacatcctgctgagtccattctttttgacgacgatataatttcattttatcggcaaatttcaataagttctcctaccttcaattaaatttatttcccgggaaattaactatgcttaaactttaccgaagaagacgatatttgtcacgctaagaatcatagcaaacaaaaaggctggagaaacttccaaccttctgtaaatcttaaattaccaaatatgaacccgatcttctggcgcccggtacatttcattcccaggcttaatgtcaaatgctgtgtagaagtcatcgagattttctgcttgaatattagcacgtaatttttgcggtgcatgaacatcaattgaaagcagtaattgcatgtactgttccgttgccttcattcgccaaatagttgcccagttaataaagaattcttgggcattgaagtccgcttcagtttttgctgcttcaagtgcacaactgaggcctcctgcatcggcaatattttcagaaaccgtgagcttcccgtttaccttttgaccagcaaatgggatcccatcaaattcttcaatcatcttttgagctaattgcttaaagtgtgcagaatcttcatctgtccaccagttattaagatttccaaactcatcaaataatgacccgttgttgtcaaaggcgtgagaaatttcatgggcgattactgcgccaattccaccataattttggctgctgctttgtttcaacgagtagaacggtgcctgtaggattgccgctgggaatacaatgatattcttaaatgggtggtagtaagcattgactgtggccgcactcatttcccaccgcatccgatcaacaggtttattccaacgactgaataattctttattagccgtcactgttaattgatttaagtttgcaatcaaagattcctcttcatcaaccttaaattgatcataaagagcaggaatcttatctggatacccaacttgaatgcccagtttatcaagcttgaggatagccttatcacgggtatccttactaagccattgattattggtcaagcgtcccttatagactttaatcatttgctcaaccatatggtgcacgtctgccttggcttgcggtccaaagtacttcttcccataataatccccagctacttggctaaacatgtcacgtgctagatagaacgcaaatttacgctgactaactggtttcttgcttccagaaagtgctcgaccataacgtccattgatttcacgcatttcatcatcaaggtaactagcattttcgcgaataacacgaattaatgcccagtttttaaagagctcaaagttaccttgtaagatcttattcagggccttaaaatattctggttctgtcacaattaccttttccggttcttccccaactaactgcttaattattgccgcaatatcaagttggtcagtcgcactggctagttctgcaaccgtttgtggattatacatcttactataatcagccgcttcttcagcactctttacatttggcgcaagaagggcatcgaatttgattgcatcatcaataatcttttttgcttcttctttgctataccccagcttatccatcaaggcttccaccattgaagaccacaattggagtaattgatcgtgctgagccttcttttctgcttcatagtagctcttatcaggcaaaataagcgatggtgatgaggcaaataaagcataaacagtcgcattcttcatatcagcgtcaatatcaaaactaatcggtgaaggcatccctgctaaaatccagttcttccattgagattggtaatcttcatatgaattaagattttctacacttgctaacatccgtttaagcggttgcgggccaaccttcttacgccaatcaaactttttagcgaggcgatatagcttaatcatctcattaaaccgcgaatcatcagacttttccttccccgttgcataggcatcaaagtcatacatcagctgcttgtcaatctcatcaacgaggtcattgaagcccccagtagctggcttatcatcaggaatcttcgccgtctttagccattccccgtttactgcttcgtataagtcgtctttaattaattcgttattcactgccatgtgcagggcctccttaaaaggttacattacttactattatactatgcctactataaattcacgtaaatttgcttcaatctaaaaaaggacttaataaagttttccgggcactttctgaaaaccatgagtcatgttgcatcattaattgatttacttcctggtaactgcttaagtcaaccttgcccttaatcaatccagcaatttggagctgccgagcaaattgaacatctgcggactggagaacattgcgaaagatcggctgctcatctggatcccaccgtttattaagaagaccaattgctcgctcatattccttgctatgggtaagtaccttttgcatggcttgtggatttaaaattgtcgtcatcaattatcccctcatttctaatactcttcccggtggctcttttactgataattgattagcctttgtcatcattagccaataaacattttgataatgataattattgattcgttcctctccccacccatcagtaataatgataattatgcgatttcgtttagttaggtggtgcagatggagatagtcaaaaacacattgaaaacttgtacccccgccaccagttcgtctaaaatcaagttttttaccatcatgtagtttttgcttggcagtcacccgggcatcaaacgagtaaacgttagctgtcagtttcgttttcttaagcatcttttcaagcgtcgttagtgtttgaacgatttcttgatcggtgactgatccggaattatcaacaaaaatgtcaacagccggatccaatctcgtaactttgccaggcaaatccattcgcaatggttgccggcgattaaagcgagcatgcgaattaacttgtcctcgtgcaatcaacccaaactgatgcctaagaacctgccgccaatcaactattttggtttggtgcgctttttgcaactgtgcttttacatttcctggtaataaaccgcgatctcgttgcggggtttgcttccaagaacgattcaaaatccgcttaatattcgctaagcgtacgacctgattgctgacctgttgacttgtcttaggttcctgccagccgttatgagtatcggctgttttaacctcatctgccgttgcattttccttttgtttgctgccattcaaattaaggcctggctgatgtagtttttcttgttgttcagcaggcagctgttctaatatattgagataatcctgcgaatctaattttggcattagcttttgacgaagaaccttttccaattggctaagggttactgttccctggggtgactcagttaaatactggtttaccgctacatcggttgcaatctggactaaatcttgatgaggataagaagcataacgtaatggatgcatccagataaggtgaagggcttcatgttctaataagctttgaagttcatcattacgaacgtgcactaacttttctggattaataaccagtacaaggtgattgtcttcccacctcaatcccatcattgcgggtaactgtaaatcattctctcgtggaagttgtaataacacttctccgaaaaggcgctgtttttgaaggatgctaataattgccttcctaatctgttgtgcggacgttacatgattatcgcttccgtcattttgatgtaaccgtgccaggaagtcacctaaactcatcgattatcaccacgcgtcgcaacctccgcaaaatattgataaagttgcgctacagagccttggggatgtttgatggcttgttcatacattgcttgcaagaggtcaatgaaatcttcaccaactgtttgaacaatcgcatactgaccatcctcactaactaattggagatacttaataaatagagctgcctcttcttcagatgccaacttaggactgagccatgaccgtaatacttgaattttggttgcttcatcagcattttcaaactgctccttgccatttttagcatctttcaagatcgctactgtaagctcttgaccctgtgcaaggacaaactgagcaaaggccacccctacttcgtcacctaagtcaccactaaatatatctgcagcaagttctttttgcattttctgatctaacgcctgtaattgatcaagattgcgggaaactctttcccaagcacgtggcgtgggagccaaatcttcattgttcggatcaataactaataattgttcagggtattgcgtaagataggcggaaacaaggtcattaattccagcggtcttggcccattttaaccattcagccgtcgaactcgtcattactaaacgaactgtccgatctttaattgcagcatccccagtcgcaacaccatattcacgatcggtaaaacctgtcatcgtagaatcgggattctccgcaataatgatccgcactgtggaaggcaaccgcaaagaattaatctttcgttgaaggacaaggttcattagttcactttgaacagcttgcgttccgcgattaaattcatctaaaaaccaaataattgattgattaggatgggcttcggcatacttaataatgctgaccaaagtttcagagtaaccaaatttcacatttgcaaggcgaccgtaatttttcgtttcaacaaaggattcgctggtcaagggaggaaccggaattgcaaggtctcctttttcacttaagctgacaaccgtagtaaataatgccgcattcagattagcagcaatttcacgaactaaagcagatttaccgatgcccgcatccccgacaatattcggaacattacccgcatcaagaacaacaggaactgccgttaatagttgttgataagttagcgccattatttaccccttccagccatgacattccagatccatgtcttgttttttcacgtttgatacatagggattgccttttacataaaagcggcgtggacttaacccgtcctttccctttaaattaactccaatccgcgcagaaatagctatttctccaggaattttataattatgtaaatcaaccgttagtggacttgtttccattggctgcccgtctaagtctcgtgaatgaattccaagagcttgtactaatttaccgggaccgttagtaatatttacccctgacatgtgccgattttcgatcattttatcgatgtttagcgccggttctattccgcgaagtaaaattccttgaggttcttctgcatcctgaaccacaatatcaaaacaataatgtccacggatttggtataggtagatattcccgggcatcccatacaaagattccgagtagccagtgcgtcgtccgttaaaagcatgcgatgcagaatctttttctcctaaatatgcttctgtttcaacaatataaccaccaatgattccacttttagtttggtattttactagtttccctaaaagatccttcgcaatttcgactgtgggccgtccagtaaaaaattgttgatattttgttagcatatttattttcctcctaaaaagaactatcctaaacataacactaattaaaggagattggcatgatggaactaaaaattgaacgaatctatactaaacctgttgatttagatggttatcgtatcctcgttgaccgcatttggccacgcgggatttcaaaagaaaatgcacatcttgataagtggctcaaagaagtcggacccagtactgagcttcggaaatggtttggtcatgatgtggctcgctatccagaattcaaagaacgttatctagcagaattaaccaacaatcctgtttactataattcattaaaggcaattgtccaaagtcagttgccaagccaaaacgttattctcctttacggggcaaaagatgaagaacataatcaagcagttattcttgctgacaagcttcgaaaagatttacaactaatataaatcaataattttgtattttttaggaataatttgttttataataaaatatgaggattttattcataattctctattacccattgtttcactgatctagttatataaaaaccttttgaaggtagcgctatctcaaaggttttttataagcttttttagtgaccttttctaatcgtgcaattagaattacgggtatcaataaccccctagtttcattttgaaacaattatctgataaggtggaagtctattattgaagtggtaggtagacttctgctttatatttttaaatcaattatttatcagcccaactacgaccatcaagctcaccagcggcattgactaggcgttgtgcttgtttaagcattaactgatctaacgcccggtaaaaagcttgatcttcatatgttgggctatttttcattaattttgttagttcttcatgtgcccattgttgattctcattcatttttagtcatcctctttttctcgtagccagccgatagaagtgtgtaaatcatctagctcttcttgttggtcttgtaaaagtgccaataattgttctaatttagcttgttgaagaagatctgactcttgagcaattttaacgttaaggtggtcaataaaccattgcgtctgatcgctaaaatgcaagaatttatctaaggtcaaatattgctgatagtggataaataataactgtcgctcttcttcactctgttgggcaaattgatagatcggtaatggtggtaaatacttcatctccattgcgtgcgctaaagcctgatatggtcgtaaaatttcagcaattgtatatccttgactggcgcctggttgaaaggcagaggcagaatgagcaaccgtcgtaacaatccccaattcacggccttttagcaaatagctacttgtaagttgtgaattccatacctcatcaagccattgctttaagattgctggcgcactataccaatacagcggaaattgaaaaataattcgggttgctgatttaagtaattcctgctcttgagaaatatcaaaaggtgtttttaattcatgccacataacgttattttcattatcagcggctgcctttaaaaacgattcagtcgatgaatttgcaagttgagggtgcgccactatcaccagtgttttcatcaatttcactcctttaattctacaagaccttgtttcagtacatcttctgtaacatcgacagttaaaaatcgttgcagcggcgtttcactatgacgatccttaaaagccattggttctgcttttagaattacaacagtcaagttattttccgtcagcattaactgacctggatgattaaattttcccttagtatgttttccagtccgccaagtatgtaattttgcctcgccattttggtcaaactttaactggtactttccactagcatctgtttccacgggaattccggtaaacttttgaacatcatacttatcttttttactcataatatatccttcttaataattaatctaattttacagttccgcttttaattggtccgcataggtattaacctcatcctgttggtcttcacttgtgtagtaattatttatcaaattcgtaacagtggtatgcgtagtagtcattggtgcccctgccacactttgattttcagttggttcaatcattttaattgtgacatcattgcctttacgtttaaaccaaatatagctagtcggatccccttgtgttgttacatattgataatccgcaacttcaccataaccataatgtgttccataatacatttcaccattttgaactcctgccttaaaccaatcagggttctttaacaatgcaactaatgttcctagctgctgagtagttaatccatccttatccgtaattgtaactttaccacgcatatcaataatttgggtattttttgccactttcaaaacacggttaacttccccatgagttttggcatacgtcaccatttcagcgagtgttactcctgttttgcgaataccgttactactgttcgcatagtaaaccttattcccgacgattgtatagtaggttgaatttaaacgatcgccatcttcatcacttgcggaagttaatttaatcgtgtataaaactttggcgtccttaggataagtcttagtagaaggtccctctccccaaggcactgcctctttatcataaatcttaaccgttgctccctgattgttattttccatatcagcagaatagtcgtaatcattcgctcctggcatatgcgcatcccgataatacaacacaagcgcagcaatctgctcaggcgttaatcgttcagcgtttagtgctgcatcatcccttgtttgttgtgtactcgataaagaactagtcacactgcttgttgatccattagtacttgaggatgttcttccacaagccaccatgaccatcatcgtcaatgaaagcatcaaaattagtgctatttttctcataaagatactccccacagatcttatacttagagccttattataccttaatctttaggagttacctaaaaagcctccatgattgatttggagacttccttctcattttattcagcaaaataatccttaattttcttgtctgacaagttaaacttttcttttatttcttttctgattgttgtttcatcaatattcagctctctcattgccaaaatagatgttttaattattgtctgctgattttcgtgtagtttttgttctctttcttgaattagctgttctttttctttaagtcgatcctgaccttctttaatttcacgtttacctttctggagctctcgttttcccttttgaagctctcgttttccttctagaagttcacgtttgccatcccgtatcttacgttcaccctcacgaatctttttctcgcgcatttcttgatccatttcatatactgaacgtcgcatgtattccgacctccatttccgattccgctttacaactgctattctctcctttaattttacgacaagcggatcggttgcttcaacttttcgttgggcaatcatatctaaaaacgcctgcatcttaggatcaacatcgtgacgcaaggaagggacgttaaataagatatcggtttgtccgtcttctataatttgttcgggaatttcatcaatatgcttatgtaatacataacgttgctggccaagctggaatggatcaaaattgcagaagaaaatcacataggaatcatcagcttgttcatatggctgtcctttatcataagcctccattgagctggcagtttgataataacgaattcgtttagcgatattgtggtggtcagctacttgcatctcaatatcataatggttaccttgttcgtcggtcgtatagatgtcaaaacgcactgccttagcatcaggagcgacagcaaactcttgctgattattaggcaacttaatctttttaatatgcaagtccggtaagatccgacgtaaaacttctaaacaaatatcataatcaagcatcaccttattgaagatatagtcatcggctaagcctgccatctcccactttttacgcaagaattcattcatccttatgaccctcctgttagatagttctataaagatatatacgtaaaagacaaggatttgcacttttttactcaatatttttccaatgtatcattaatgcatattaataatgctttatcttttggctatggataagattcgactataatagagagtgaaaagtaaatcttctttattaggtattatctatggtatgtgtagataggatgttgaaaggaagtaatactatgttcgacgttatcttttggattcttgcaatctggtttgtagtaaacgttgtatggatgtggtttgcccttaacaatcaaattctacaaaagacattcgcatggattaatgtatgtgctatcgtaattggtttttgggtatactacggcatgacacacgacggcaacgtacttaatggctggttccttacaatgaattgggtcaacattgcaattgctgctatccaattctactttggttatcgtgaaaataacgttacccacaacggtcacacaaccgcatgattgatttacttttcaattacagggctatggcttagggtcatggttctttttagtaaaaaagaagagagtgtggaaaaaacttcagttttttccacactctcttctcaattttccggcttgatgacttaaactatttaaattctaaaacatataaaagcaatttattactatacactgaaaatacacttacttcttcccaaacaaagctgccatctttgctgctacttcgggatcaagattatcggcaagcgtactttcatttgatttttgttcattttgctgattggtgatcgtctgcttaaggtcatcaatgactgcttgttcaccaacttcaatcggattaaccgttaatcggccacctgctgcatcagcatgaccgccaccattaaagtatttttcagcaaatttagccacatctaactttccgttgcttcgaagcgacacgctaaccggactgactaccaaggccgcgtcgacttctggatgttgcactaataattcgtgggcaatttcagatttatagtcacttgcatatacgaccccaaacttatgatcatcgatatctgtaattaaaacatctttcaaatggctcttaaggtactttgcccgccgttcgtttagggtccgaatcaacaaccgattttcttcctgatattgttgccaactggtattaaaaacattttggacaaactcttccgaatcttggagggggtaaaaccaaaagagctgatcaagattatcggcatcaattcgttcctgctcattcatttctggatcattttgccaatcccaagtatcatatgcccgaatcaattccacaagataagcaagatctttttgccgttgctcatcaaccttcgcaaaagacgattgttgttttaaccaatcccataccaagcttgtggcacttgggttaactgttggatcagcaggtacgatactattggccgcatacttttgtcgtagttctgcttcactttcatgatgatcaaagacaagccaatgattagcgaaacgttcattcaataacttaaatgaataatcactatctggcgtcatatccatgatgtaaacatctgtaaatcgccctacttctgctgtttgcatccatcgacttaattcttcatcgattcgtccagcgccacagtttgtcatatcaaactctgtgtcttcaaacattactggttgtagtgtttttaataataatggagccccgaatccatctaaatcattgtgggaaaataattttattaaccgttgtgccattttcgatcctcgcaattctgattttgtttcttattataccgtagaaaatcggctaaaccacacttaattactgacatcacgctaacgaactgctatcattgaaattagtaacttattttaagaaaggaaaacaatatggaagtttatgattatcgtcaagaattgattgacctcttaaataataccgctgatgatccacaaagcttactgcagacacagcggagtcttaccaccattcttaatattttaaatcattatcaggaaagcaaacccgttaaacaaaatgcacctcggtttgttcaacgcaaagttcaatcatcaaacgagttgcctccgcaagcacgcaaaacattgaagtcactgcttaccggtccagctaatgatgaagaaaagtcaacatcaataacaagctccgctacatcttcttcagttgaagcaccaaaagaaatcaccgaagaagaacgcctagcagccgacaaccgctacttagtacaccggaaattaagcggtgccgagattaatcaccgttactacccggaagtaattctgcatgcattaccatttcctgttgaagatggggacattgcccaactcgattatgagcaaaaggtccgtggccttccagttattcggcggatcaccggtgaccatcttagcgattacactcctgaaaaagtcaatgtgattgaatatggtgaattgaaacgcgtgcccggttctgatgtccttcaactgagtaaaacaattaagggaaattcaatcgtggatgaagcgccagagaatactattgtaattgatccttttaagtacccgggccgcgatattaagcctggaatggttattgattttgcctactatgatcgaggaaatggcctaactgatgccaaagatggcgccattcgctggattcatgaaaagcaagattatgatacaaccaagcaaccagctaaaccaaaagttgttaaaaagcctgctaatcctcgtcatgattatgaaaagaaacttgattatgaccttcaccaacgaaaggtacttgttattaccggaatccgcagcaaggttaaaggtcttaaaccagtcgtcgataaacaccacggtctgttccgcggattagacgcgtctgcagaagaaaaagtttccagcagtaaattaaaacgtgaaattcgggatgcggactttgtgattgtctgcatcgatgcaattcaccatcggattagtcaactcgccaatcatcacgctaaacgttatgagaagccactcgccattgcaaatgttacttctaatactgctgttgagcgagccattgcccgggcattaaatggtgatcctgcatacgccgaaagcagcgaagatttgaaaaattataaataatttttaatttactgttgacttttatgagaaataggttaatattaatgacaacaatttaattattcgatcgcaatgagaaagaagagtatgttagacgatagcttcagcgagtctcgtttggtgtgaggagacagttttaactctaactgaaaatcactttcgagtctacagcttaaataccagtaagctgtagtggttacacccattatcgtgtcagcgtatcgccattatggccgtacgtgtgaggtattgttagcaatagcagtacaatgatagggtggtaccacgctcagcgtcccttagccagtttggctaagggacttttttgttgggatcagattaggaggagaaaacatgcaagatttaacatcgcgcaagttaacattcaaaaactatttagttgttgcatcattgcttttcggtttattctttggggccggaaacttgattttcccgttacaccttggtcaattagctggtagtcattggggaccagctgcagttggctttctgattactggagttcttttaccacttctatcagttctcgccgttgctgttacgcgtgcagaaggagtctttgatatcggtcgtccgcttggcgttggttttgccttagtattcatggttcttatccacgctacgatcggtccattattcggtaccccacgaactgccactgtctcattcacagttgggcttgccccattcgttgataaacaatatcaatcccttgccttgctattattctcagcattattcttcggggcggccttcctcttctcataccgggaaaatgacatcctagctaatatcggaaaagtattaaatcccgtcttcttagcccttttattccttgtctttgttgtcggtttcgctcgtccgcttggtaaccctgctactgcacctacaactagtgcttatgttcacggtgcactcactaacggattccttgaagggtacaacactatggatgctcttgctggtcttgcgtttggggttacagttgttactgccgttcgttcaatgggccaacgtactgaaaaggatgtctccaaggttgttgctaaagccggtgtcctctcaatgggtgccgttgcttttatctacttattactaatccttcttggcgcaatgtctcttggtcgtttcaaagtttccccagatggtggagttgcctttaaccaattagttaatgcttatgccggtgcattcggacaagttgtactagcattcttgttaactgtcacttgtttaacgacggctgttggtttagttgctgcttttgctcaagacttccataagcactttccaaaggttagctaccatgcatggcttgctctcagttgccttgcctctttccttactgctaattttggcttagaccaaatcattgcttggtcaacaccaatgttaatgttcctttacccattatcaatggtgcttatccttttatctgtgacatcaccactctttaaccgtgatggcgttgtctacttcttcgtggtccttttcaccgttgtaccagctctcggtgatatggttgttgctttcccagcggttgttagccaaagttcatttggtttatctgttgctgctttgcgaaataacttaccacttgcaagtatgggattatcctggcttgttccagcacttgtcggcttagtccttggtctcttagttcactggtaccgtcatcaacgggttgcttccaccagtatgcaaagtgaagtacattaataagtgttttataggttaaaaaagcgtgagaaatagctcattacaagagtcgtttctcacgcttttaaattattatttaacattatcgtattgggcaagattaaacttcttaatcgcatagatcagcttgctggcataatctggatcggttgcgtaaccattccgctgtaattcgtaagctgcctgttgataagtttttgctgtttgtactccatggaaacgtgcatgattatcaaccgttccatttacaatgagcaatgtgtgcgcattaattgaatcagcccagctattgtaaactgtaaagtattgttttacttgaacatttttaccacgaatattttcggtagtatacatttgcaccttttcgtcgtcactattagccttgattccaaataagttattgtatttatttgctaaccggctccgaccccagttcgattcaagtcctgcttgtgcaatcgtaatgctagccgggatatgatatttcttctgttcacgttgagcagctggtgcaatctgacgaacaaattcattgacggttatatctgttgggtgggtctcacgttgaatttggggagattcgtggataataatcgccacaatcccaaataaaataatcaaaaacgcaagcacacttccacaaatgatttttgtttcttttttcaagatgtgtctttcctttttatgaatttgacgctattataaccacttcaccataagaaagcgagaatttacaataatcttatttacttttaagatcatttttatagttattaaagtatttactatcagtcatcttcatcttagggaagctcttgattagccggcgatgattccagcttagttgcttgccagctccctctttgtttagatattgagcaaagtgccgttgccaatcttgaaggcgatctttaattgccaatttatccttaggagctgctttttcaagtcgatccagcagtttctttctgtacgcggctgctcgttcatcccattgctgagttgtaatatggaatttttccacactaataacgctgaggatagtgtcagttcccatcacgaggacgataattagggcaagcatcccgtgagtccatgattcttcccagttaataatccgctgaataaatggctgaacaaacttaaccagcaatacaacgccaatcccccagaaaaatgaaatttggggagcaactcttccttgaatgtttccttttagatgcgaatagtcccataacttcatatgaaaaagtttttcgagcagccaactcgctacatactcaaagatcgaagccacaataaaccctactacgaatagcagaaaaatattattttggaacggataggtagtaatcaaaatcgtcgtaacggcaaatccatatactggacaataagggccaaataagaatccccggtaggcaaaatgatggtccttaattgaacagtaacaggtttcccataaccagccaataaatgaataggtaaaaaataagacaatgatttcaggaagtgaatagggcactcgtttcccctcctttttgaattcattgtctcatatatttctatttcaagctaagtttttcaacgttcaggatcttatcaagccatccttcaaagaatccttgttcgtgactaactaaaattaaatttcccgggaaatcttgcagggctttcttcaacccttccttagtttcgtcgtccaggtgatttgtcggttcgtccatgatgaggaaattacatggggttaattcaaggatcgccaacttaactttcgtctgctctcccccagacaaaaggttcatttccttcatcgtgttggcggcgttgattccggcacgcgcaagttttgtccgaatcgtccgtggctgcatcgttgggaacatattttgaattgtttgcagtggtgtaagggttgggtcatcccactccaaatcttgatcaaagtaatttatccgggcggatggggagaaagttgcttttccgtccaacgctggaattttctttaaaatcgatttgatcaaagtcgacttaccaaccccgttaaatccagtgaataataatttttcacccattgtcattgagaaagttaccggtgccagtagtggtcggttataaccaactgataatttttctacccgcaacgcattcgctgatccagtattttcatatggaaaatggaaagttgcttttagattatcttcaggtggatcaattttcttcattcgcgcaagcatcttttcccgtgacttagccatagtcgattttgaaccagctttgtttttccgaataaaccgttgcgccttttcaatgactacttgctgcttctcatattcccgctcttgggcttccttgcgctcttccttttgccgcattgcttgttggaagcttccccggtacttagtgattttaccaaatgatacatcacaaatagtattcgtgacttgttcaaggaaatcatagtcgtgagagatgatcattgcggcaccatcaaaatcattaagatagtcgattaaccattcaatgtgggctgtatcaaggtagtttgtcggttcgtctagtaagatgacatctggattctccaatagcatcttggcaaggataatctttgaccgctgtcccccactcatctcagaaataacatgatccttaccaatatcagttaatcccaaaccgttcattacccgctctacttccgtttcaatttcatagaagttattagcatcgagtttttcttgaattcggcctgctttggtgaggagctcatcatccatcttttctgcataatccgcataaagcttattcatctggtcattaagttgataaagttccgtgaaagcagtatgaaggaagtcaatcaaggtcatccccgctggaatatcaacgtactggtctaagtatccaatcttgactcctttttgccatttgatagtgccatcgactgggagggttttcccgatcaagattttaatcaaggtactcttcccggcaccattttgcccgacaatccccatatgttcgtgcttttctagttgaaagctggcatcctcatagagctttttatcggcatagctcatcgtcagtccttcaacatctaatactgccattatattctctcctctttttcttacttattacgagctaaaactgctatccatactatcatattttaggcacgagcttcaatttattgggataattccagcaagtaagttattttctactgctcatgcaaaaccaaaaatttccaaggcagaagttatgattccgataataagttaataaaacactatatatgaaaataaagatatgtacattacatactggtggtattagagccaaagttaaattaacaaactcataagataaaacattaactgatatatataagctaacgtagaaaagtaacaatactattttatcatcttgcaaatcagactaatcaattttttcatgtcccagatctgtggtagttcttttacttctcttttgatactattaaataaatcactaaagaggagtaacctcatgaacttcgacaataactcagtagtaacaattggctcagcactaaactgtttatttctcattggcttaattgtatttgataagtattgggacaatgtatcaggatgggtattttactcgtacattttgtttatgataatcaacgccatcatattaattgtttatgctgcaaaaagcaaaaaataggatccatttgtaataattgacccaatttgcacagctgcatagtttctttcctattgctaccgatttcaaaacgacagctgaaaatacttgattaatcttatcataagctgttaaagtaatttagcatttcagcagaattaaaccagcgtctgtccttgtggcgggcgttttttgtttaggcttattattacttatccatactggtatagcagggtgctaaaggagcgctctttttatttctaaagttaaagaagtacatacctatataaaaaacatcttagatttcttcatccaagatgttttcaattatgctattaaatttatcttaaacatactatggccaaaaaagcatcgaaagaacaaaaataccaaaacaaaagtaaaggatagctaatcccttatggtgtttatcaactgaagcatcattgtcaccaaatatatttcccgcaacaaaccgatagaatttcttgtttcggcgatatattccccagccaaaccaaaagaagaaaattcctacaccccagattaatatggtagttgccaatttaactcaccttctaatttacttggatcgggtaaatctaattctgtatatactttttatattcctacgatgtgaatcattaaataatgttagtgcatatttaaataagttgtttttttagttttattctattattcatggtaaaaacttaactaataaaataatccataaccaagcaaattgtttcacaatgaattatactttcaagtacctacttgcgttataaaaagaattttctaaaatttaaagaaagttagaaattaggagataagatttatctacgaatagacaaaggagaagaaatattagattctatacttcttacctgcaaaaagtatgagatttcttcagcaactttttatggattagaggcatgtggcaaagctgtaattgggacatatattcctgaaaagcatgattttttacttcataccaaagaaggtatgttagaacttgtgagcttgatgggtaaaaacacagaaattcacgctcatgccatgttttcctatttcgattctgagagtaatgatattaagtattttgggaggaacatacagatgaaagaaacaatcagcaccaaaatcattaagtggttttacggtattcatggaccattagatgaatatcgccgcaatgaactcaatcgaatcggtaataatattgccatatttttattatcaataaatctattattaagttttattgctagccttttaatgcttaatactaataattctgaacttactcttgatatcgtagtaagcgtcctactattaactgttttcgcttcttcaggctatattctatatgaaactaaacgacatcatttaacagaaattgatgttgaagccaaacaggagggcaaaactaaacaaaaatttattaaaagagctattgtcctaggaatttattttgccttcataatatatggattaacaatacttatagattggctgcctaatagaggagcactaattccattacttacagaatcttctacaattagtagtgctattttcagcggcattgtctacggaatattgatgggtacttgggaaatacatcaaattaaaagcgatcctaatgacaaaaaggtaactcaaaatcacttacatcaaaaatattggttagttttatttattattatcgttattactagtcttctgttaatgcataagtaatcatatttacaaaaaaaggaaggcaacattatgaaacccaataataaacttataagagaatgctccaaagttgaatacatcactttcaatgacaaaactcgaaaggcagtagttcgtgcgtatgctgaagaaaaaggaattattccagatactgcaaaaacctttgataatactgatgacgcaatgagggagcttttcaatgacaaataataattgaaaagttagttttgaccgtcaatttcaacttgatattgattttgactaacacatttctcgatttcattttagttgttttctcaattttaaatatttatcaattgagcgccctaattcaaacacagagcctataaacaaaaaattaataattgcttttaaccagctccatggaatcatatttcttaaacaaaatccagcaattgttagtattatcaaagatgaataaatgtaaaaatcgcttctaagctcttttatttccttttgaatcttatcattagatttcgtcataatagttcctttctcaggaagaataattgtatctagtcataataccatatgccaatgtagataccttaacaatatctccttaatttataaggaataaaaaatttgatcgaattgattttagttaaagaaaaacaacctaagattaattcccaaccacttttgctatacgccgcagtcacagcgctttgtcgcgtatagagaatttttattccaataatttgaggagaaaattattacagcaatttaacaattatgtaacaaccgtcacccttaagagatttttcatatcttcttcacaatatcatcatatagtaaaagagtgcacaaattagttgcatgcataaaagaaaaataaataataattcaggagtgaataattatcgctaagaaaaaaacaatgtcaaaagtccttgctgctgccttaggtgctgctggtgcattagctgttgctaacaccgcaagtgctgatacacaagttcaagtacaatcaggagatacagtatggggatttgctcaacaatacgctactactgttgattcaatttctactgctaaccaattagctgaccctaacgtaatttacgttggtcaacaattagttatcccatcttctgctatcagtactgcttctgctgccgcaactgttgctgcacctactgcaactgataacgctactgctagtcaagcagccgttgaaactactgaaacaaccgctgcatcaactacgccagctgtttctaccacaaacgcaagcaacgtagccgaccaagcacaaccaacaaccgtcgtatctgcttctgataacaatactgctgctcaagttagtgttgcatcccaagctccagcccaagtaagtgctgcttctgctactattagcgttgctcaaactagtgctgcaaatactaacaacaacgttactactttagcggctactactaacactgcagcgccaacacaaactacatacgctgctactgaagcagtcgctactccacaaagcaacactactgttcaaagtactgctgctggtcaaggtaatggttctactgctaatgcggttgccgttgctcaagcacaaattggtactccatatgtttggggtggtaaccaaccaggcggatttgactgctcaggattagttcaatatgcatatggtcttggttcaaactaccggactacttaccaacaaactaaccttggtacccaccaatacgatatccaaaacgctcaaagtggtgacctttacttctggggtccagatagtgctccttaccacgttgcaatcgctactggtaatggtggttacatccaagctcctacaccaggtcaaaacgttcaaactggtaatatcaactactacactcctagcttctacatcagcatgaactaggatacgagtagtataattattgagtaagatagaggattttcttctaccttactcttttttcttagcaaattttaataattatattgacagctttattatcattggttatacttaacaacaatcaattatgtagggagtaagtataatgaacgtatatcaaactatcaacgttaatattcgttggcaaagccggtaattcaggttgtttcgtcatggatgcgacctgaagaacagattgcatctgtgccggctgagtttgatgttcatttcagtccgcatggatccacatgcggacttttattttgcctttcaaaaagcgagggtccgtcatgtgggctctcgtttttttattattttgtgaggtgagattttagatgaaaagaatgtatagtttaattgcaattattatcgctttcctttgtttcgcattttttagggaaaacaatgggttcgtaactaagcaacgaattccaaaagttggtgtattaaccttaatgcaccacccagcgttagatgaaatttacaaaggatatgttgatgaattagcaaaggaaggttaccacaacggtaagaatatcaagattgagtatcaaaacgcgaatggtgaccaaagtaatcttaaaacaatggcttcaaaactcgttgatgataactcaactgttctttttggaattacgacccctgctgctcaagcattagctaattctactaccaaaacaccaattgtacttggtgctgttaccgatccaaaagcagcgggactagttaaaaataatcaacaccctggcggcaatatcaccggagtatctgaccaagcaccaattcgcgaacaactcaatttgatcaagcaattcatgccgcgaatgaaaacactgggagtcatctacacttcaagtgatgcttcagcagtagccggttaccaccaaatcaagcgtgaatgtcgtaagatgaatattaacttaaaggcttattcaattgccaacagtaacgacttaaaccaggtttccgaacaaatgcttagccaggttgatgcagtaattgtaccaacagataatacgatcgctggggcaatgcaaaccttagttaagaatgccgatgccgctaacaaaccagtcttcccagcaactgacacaatggttaagcaaggtggcgttgcaacttacagtgttaaccaacgcgctctaggtgtccaaggtgcaaagatgacggtcgcaatcctcaaaggcaagtcaaagccagctgataccccaattaaatacatgaagcatgggactcctgttctcaacattaaacaggctcgaaaacttaatttacaaattcccgctcaatttgaaaaggatgcagaaacgaaaggagaggtttacaaatgaatctaatcgtatcatcaatcggtcaaggactattatgggctttacttggtcttggtctttacctgacttttagaattcttgattttgctgatatgactgttgaagggactttccctcttggggctgccagtgctgtcgctgcaatcacacatggcattaatccctttctggcaactttaattgcgattggggcgggaatgctcgctggtttgatcactggattgctctacactaaaggaaaaatcccaagtttattagccggaattctaactatgaccgccgcctactccgttaacctccgtattatgggtaaatcaaatgtttcgttgcttggtcaaaagactctctttagcggcgaattcatgcgaagtctaccccaatactttgatagtgtcttcttgggaatagttacgattgcgattattaccgtaatcctggttttcttcctttcaactgactatgggcaggcttttatcgcaactggtgataatcctgtgatggcaaaatcatttgggattcataccgacacaatggtcatcatcggtctaatggtatcaaatgggatcgttggactttgtggtgcgttgattgctcaaaataatggatacgctgatattaatatggggattggaacgattgttatcgcccttgcctcaatcattattggtgaagtatcctttggtgaattaacgcttaaccagcgacttgtcgccgttactcttggtagtatcatttaccgaatcatcttacttgccgtcctccaacttggtttctctgccaacgacctcaaccttatctcctcagttgtccttgcaatctgcatgatgttaccacaacttgaagaacgtattcaccttaaaaagccaattttgaaaggagtccggcctcatgaataaacctattttggaattacagggcgtcaaaaccatcgttaataagggcacatctagtgaaaccactattcttaagggcttaaaccttaaaatcaacgagggagacttcattacgatcgttggaacaaatggtgctggtaaatcgaccctttttaatgtcattggtggaaacctacacgctgacgaaggaaaaattttacataatggacaagatattaccaatacgacagaagaacagcgaacagctttcttatcccgtgtttttcaggatccgaaactgggaacggctgcacgaatgacagttgctgaaaacatgctattagcaactaaacgtggtgaacgtcgccatcttattccccggaagctcaaaagtaatatggaccgtttcaccaagctagctgcaacaatgaataacggtcttgagaatcgcatgaatacagctactggcgccctttccgggggacaacggcaagcattaagctttttaatggcaacaatcaaacgacctgacgttattttgctggatgaacacaccgctgctcttgatcctcatacaagtttaaatctattacacgctactaatgaacggatcactaaagatcatttaactgccctaatgattacccataaccttgaagatgccttagagtatggaaatcgtctaatcgtgcttaaagatggtgaaatcaaagcagattttaatgcagagcaacgaaaatcgcttacccctgagaaactttatacttattttgaaggatagtttgactatatatcaaattcgatatatatattaagtatatcgaatttgatatataggagacctaattatgaattggtggattatttttatcacatttcttgccgtaaacctcgatttctttttcatcttaatctttttactcgaaaggtataaccttcgtgatgtaatcattggctatcttggtgcccttcttgttctggttaccatcagctttttactaggaaaaactctcgccattttcctccctgaatggattttaggaatactagggatcctgccaatttacatggctctgcacgacaacgatgaagacccaactcatgcagaaaagcacggtccaattattaccaccttaataacctatctggcagtttgcgctggttgtaacctctcaattttcttaccaattttaacgaatcttaccttccagcaatttactcaggcacttctttttatcgcagtcctttcaattgcgatcgtgattctcattaagggaattggtaatattccactaattaagcaagcaatgcaacgttatagtgaaaccttaatgaaggttatttacattggagttggttgttatgttttttgggacagtggattaattacccaccttattcaccttctttagtttagtataataattactaaaccgattaaaaggaggagcagcaaccattgtcttccatacaagcctttattgatgaagctgctaaaatttataaagttctaagcaatagtacgcgtttaaacatcttgtattatcttcggcactatgacggtgaagctgatgttaaaacaatcgttaatgatctttatcttgcgcaaccaatcgtctcaaaacagctcggtattttatatcgttaccagttagtcagtcgccataaagaagggacacgcgtttactatgctttagatgatcctcatgttattgaaatgattgatgacatgctaaaacacgttaaacacgaaataaagggcgaaccacatccccgaaatttatataaataaagagtgaacaggaaacaactattaacgatattccctattcactctttttgttattgattatttttcactctttcgttttccagaaccaaagagactagcaaaggcagttacaagatctaaaccaataattttggacttttgcataaaaagttaataaaataatcagtctttcactttgtattctgagtagcgtaaaatggttagcagattgttaaaaggagatttaaaatggacgagctatttgaacattcttcaatcaagcgggcatactttacgctggccttacctgttgtattaagcatggctgtaaccttgatttataacatggttgatacttttttcgtggccaaaactgggaatcccaatttagttgccggtgtttctcagggagcaccaatttttacgttaatgattgctcttggggatatctttggccttggcggtagctcagttatttcccgcttattcggtgagcaccgtgataaattagcacgttttgtcagtggctattgcttctatgcaccgattatttgtggaatcatcgtaactgcaataatgattatctttcaaacaccaattttacatttattgggtgcttctcctgccacttggaaatatgcacgtgaatattacttggtgatcgcttggggtgcggttttcatcatttttggcctttcaccaactaatattttacgaacagaagggctagccattcagtcgatgatcgctagtatggtagggactggaattaatattgtcttaaatccgatctttattttcacgtgtgggctcggcgctgctggttccgcactagctactgtaacaagtgctgttattggcgatattttaatgatttattatttgcgaacaaagagtaaaaagctgacgacttcaattcatgaaacaaaaatcggctggaaactccaatttgaaatctacgctatcggaatcccggcctcggttactaacattatggcaacgtttgcggttgcgttaactaatcgttacttgattgttcatggcgcggatagtgtagctgccatggggattgcgatgaaagcaaatatgatcattaatatggtaatggttggttttgcattcggcgcgcaacccttgatcggatacgtatatggcgctaaagatgagcaacggtttaataaagttgttaaatttgatattcaagttgttgctagtcttgcctttatgctcactattattcttttcatttttgctccccaggttattcgcattttcatgaatgatccccaaatagtaaaagaaggtgccttgatgcttcgctggctatcagtttcgactactcttgctggtatcattcttgtttttacaaccatgttccaatcaatgggaaaagcaacgcctgcattttggctctcattctgtcgtcagggattgattttcggggtagtgattagtacttccgcaaaattatttggttatactggaatcattgctgctcaggctatttctgattgtttaacctttatcctggcacttattttcttctattgttatcgcccacgttttaaataaaatagatttagacatacaaaaaaggcctctcccgtttaaatttttcaaacgttagaagccttttattagtttattcagttatttttcgttcaaagtaatgagccagtttagcctctggataatatccagttaccttttctttcgcctgtccatccttaaaaaggaccagacttgggacgctcattactttataccgttgtgcaatttcttgatttccatcaacattcatccgcacaaacttgattttatcaccgtattgcttttctagattttgcatagctggttccatcattttacatggaccacaccatggtgcccaaaaatcaacaaccgtcattgagccttgaacatccttatcaaaggtctcagctgttgcatcaattgccattttattctaccttctttttctgtgatctacgtataaagtgaataataatcgttaccgcaaaaacaagcaagataaaactaccgaaaatccctgatggaatctcgatatcaattgcagggatcgttaagaagagcttaatagcaatcacaaagattaagatatatgccatcggttctaactcaggaactttgcgcatcagtttcataataacttcagcaattcctcgcatacatgcaatcccaatcaagccaccgattaaaacaataactggattatttgagacggctaacgatgctaaaacagaatcaatagagaaaataatatccataaattcaatctgtaaaacaactgtccaaaaaagcttacgcccagttaaacgtgttttaccttcacgagtctttcgcattgctcgtttaccaaagaatttattatgaaagtaacgatatacaaggtaaattaagtaagccgctccaataaccttgatttcccaaaagttaattagataaacaccgatcccgataattaagaagcgaaaaatgtaagaaccccatatcccgtagaaaagcgattcttcttgttcctttaatgtcggtaatactcgtgtctgagccgctaacacaacagcattatcaactgacagtaaacattcaatcataaccaacgaaaaaatgattaaccaatcctgtcctgatgtaacgactgttgcccagttatgtggatcaaaaaatggtccatacaacttctctaaaagtgacaattaatgtcctcccttaatttaaatttgctttttagctaagttatattttaccaaataatttttaaaatacgatggtaatggcgcactaatatttaaagatttcattacgaaaggtaatatgagtttttgcgacacaccatgaagcagcatcccttctgttgacgaaggattataaagcggatcaccaacaatcggatggccactatgcgccaaatgaaccctaagttggtgcgtacggccagttgctaagcgaagtttcactaaggaacgttcatgattacttgccaatgtttcataatatgtcaaggctggctgcgcgttttgcccgttcacttgatgaagatggggatttactggattacgtccaattgcccaatcgagctttccactctgggccatttcaccctccactactgccaaatattgtcggtggatttgcccatcactaattaatcggttaaggattggaacaacaattggattcttagcaacaattactgctccactcgtttgtaagtctatccgatggaccatataagcattattttgactatgcgctaaatagcctgcaacatcattcattaatgtccctgtttcgccatggtaattagggtgagttttttgtccccgcggtttatttactactaacaaatcgcgattctcataaaggacctctaaatgtgattgcgaagacggaatataatcatttgcggtgggggtccgaatttcatcaccacaaaataataattgaatattatcatttttctccacaatctcattcatggatcgatagttgccattaacaagcactgtccgcctaatccgcaaatagtgaattagccgattaggaagcagccattgatcatgaagtaacttgcgtaatggtttcggcacctggttatcagctaacttttcatgaatctgccaccgatatttcattttactcacctctctttcgcctaaattctgataagattattttactgtatttcccaggaaatatttagaatatttttaagtctgtttacttttatccgataatagcgttgaatagagtatgagtaaatttaaggggatgggtactgatgttaacaacagaacaaattaatgatcatagcaaatggataagtatattcgaacctctcccccatgaacgattagatttaattgaaaaatatgaggttactcaagaattacttgattacgcaattgacccctacgaaaaagcccgggttgaaattgacccagatgcaggagtcacattattaattttcgatgtctatgtgccaactcatgctgtgacagctccacagactgcaccaattggcatcatgctaaccgctaataatattattacttttacaaatgcaaaaacgaactttgtaaatggaatcattgccaatcagctacagttattaaagaagcatggtgaaaatgacgacaaattaaacttagtcttcccagttctttatcgactttcaactgactattttggcccccttcgtcgtgcagaccaacagcgacaagaaattcaacaaaatcttcaacgacgaacgggacgccaagctattacccaatttatggagattgaaactgggttagtttacattcttacctcacttaaagggaatgtgtctctacttgaagaatttaaacgtcgctttggtaaccatattactacaaagcaatataatgaccttgatgatgtaattgtcgaagcacagcaaggtctagaaatggcccagatgacttcagatgtttctgcccgtgtctctaatgcttatagcaaggttcttgatagtgacctaaaccaaacgatgaaatacctcaccatttattcaattgttctttcaattccaacaattgtatctggtttttacggtgaaaacgtcaaattacccctcgcaaatgggacgtattcatgggtttttacaatcttcattactattgtcttaatgttggcatgtgtcatctttcttattaatcgtcattggtggaaataaaaaaatagaggctgagacaacaacctctttatttatacgaactttatttaagatatcgtggaaattaaccacaaggctcgaggctaagtccgaacgataatcagcccgtgccgtgctaatcaccgttctatccttagcccaccgccttgtcgagaaggttaatttccactcactatttttataagttatcgccacgttcaaactggaacttagaattcaacaatgcttcatgcaaaagctggttaatcagttcatgtgtttcgttcagaatgtgattagcagttttcatattttgttcagttagatagttaattaaattagctgaattttgaatctgagctgtttttgtaattatgtccactcgtcctacgccatagctttgacaccgatctcggaaatcatttacttcattgataaattcatgatagcgtggttctacaatcacttctaacaatttatttaaccaataagcactcttatccggctgagcatcatcagtagcatacttatattttgccggagtatcactaatatttgtaaagaacggaacataagggctatagcaataaaagccaaaattaatccattgaatagcagcatattgtgctgggacgtcattccgaatttgcaaaatacatgaactttgattacgatcaagtgcaattgaacggaattttcgctgttccgctggtgttccagaagcataagttcccattggatcataaggagtaccgttataatgagatgagaggaagtactctacatcctcaatggcaattttcttttctgcatgttgaataaatggaattttttggctggtaggctcctgttttaaggatggagtaaagagcttttgaccataccaagaacgaggggtgttgtagtaggcatctgcctcatcctgtgtgccaaaaatatttcggaaattaaacgtttgtggatcaggatttaaatgatatttttcaacaaaatctttaatttgcggcgcatacatgaagctatcgtgatcgttaaagtcgacctcttcgatacacataatatttggtgcaattgcataagcatcatcaggaatccgttgggcaacccattgatggccaccaccggtctcaagataccaaacttcatccttatcgctaaaggcaatcccattgctttcaccagtaccgtacttttcaattaatgatccaagccgttgaacaccttcacgggcagacttaataaatggtaggacaagataaaccattgaatcttcattaattccgttttctactaacggatcatgaccaagcaccctggcatttgtcatttcggtttctgtcgcactcattgcaacattatattcattaatgccttgctcatcccagcgtccttcatcaagcacgccattgggagttgccgtataacggcatccctgtcccttcatctcaacagttaacccattatattttgaaacataatgttcaccggtgtaatccttggcaggaaatactttgaatgtcttaggattgactccatcttcagcatcctcatcacgtgcaataattgttgagccatcaatcgtagcattctttccaacaagcattgccgtacaactactcattagcttttgcataatatacgcttccttccacagtagttactgtactttctaataataccactatctggaattaaccggatcataagaaaaaaagctgaacgttagtcatacaaatcaatctaaaatatcactaataccgaacaaagcattgaaaatgttcggtattagtgataggataactacatcaaataaatagcctatataataccgaaatatggtcggttagtctctacctaaagccgtaaactttagactataagcgcttcttaaaaactgacactgtctgtttttaacttaaagcttttaaaaatcggtagaggggctgaatttttcagtctcttatttttatttaggcgtgttaatttttggggaggtatattttgaaagaacctgtttcatctattcaagcacctagtcgtcatactaaaattgatttcactcgtcaatggcaaaattttgtccttggtttccagcacttacttgcaatgtattctggggacgttcttgttccgttattaattggacattacttacacttctccacgcttcaaatgacttacctagtctcgatcgatattttcatgtgtggtgtcgcaaccctcttacaattaaagcgaacaccattaactgggattggtttgccagttgtcctcgggtgtgcagttcaagctgttactcccctcgaaacaattggtggaaagttaggaatcacttatatgtatggggccattattgctgccgggatttttgttttcctaattgctggcttttttgcccgcttaaagaagttttttccaccggtcgttactggatctttaataactattattggatttacccttgttccagtaggttttcaagacttaggaggaggtacgccaactgctgcttcatttggtgatcccgctaacctccttatcggctttctaacaattgctatcattctattattcaatgcctttgctcgtggctttatgaagtcaattgctattttattaggaattttaatttcttctttcattgcgggcgcattaggctttgtctctcttaaaccggttagtgaagctgcttggttccacgctccgcaattattcttctttggcgtgccacgttttgatatgagtgccatgatcacaatgattcttgtttcgctcacgacaatgattgagtcaaccggtgttttctttgccctcagcgacattactggccggcaattaacaaccaccgacttagaacgtggataccgtgctgaagggattgctgcaattttaggcggactttttaataccttcccttattctactttttctgaaaatgtgggtgttcttaaaatgtccggagtgaaaagccgccaacccgtttactatgccgcctttttactcttattacttggtcttttacctaaagtcggcgccctcgcaacggttattccagaacctgtccttgggggtgcaatgattgtgatgtttggaatggtcggtgttcaaggagttcaaattctccataaagttgatttctctaacaatgccaaccttcttactgcatctgtttcaattggactaggattagggattaccatgtatccgcaactgttccagcatatgccaactgaatttcaaatcatcctgggtaacgggattgtcgtcaccagtctttcggccgttcttcttaatctgttatttaatcatcggtgggctaatcatgattaattctcattcttttttaatttagttgttgacattcaaatctcagcacgatattataatttcaacaattatcgtttcagtagaaccttcgttgggcgtaagagagccggtggttaggtgcgaaccggtcaggcggagtgtttcgaattatcacgtgatctgaattgtccggccatattcagtgccgttaccacctgatatgagtgcgcataaaatcaagatgcgtaggtgggtggtaccgcgattaaaataatcgtcccgttgatacttttatcaacgggacttttttatttcttttctaaggaggaacaacgatgaagagtattcgttttaaagaggcagtaaccctcttacttatcatgctaataattttagggactgccgtgattaagtttggcttgtcaccacagatccccgtcctatttgtcatagctttacttattttttgggtcaagtttcgtggtgctagttgggacgagattcataaaggtatccaagaaggaatcgctaccgcaatcatccccatctttatctttatccttattggtgcattaattgccgtttggattcaagctggagtcatccctacaattatgattgtcggcttcaaactgattagcagtcaattttttgtcccatcaacattcattgtctgttctttagtcggtctatccattggtagtggttttacaactatttcgacaatcggaattgccttatttggaatgggagttgcacttaatgctaatcctgcgctagtagcgggtgcgatcatttcgggagctgtttttggtgataaaatgtcgccgctctctgattcaactaatcttgcctctgcaatcgcaggcagtgaccttttcgcccatatcaagaatatgatgtggtcaacgattccttcttttatcgtttcgctaattctattctggttctttggtaattccagttcccatatgagcgccggtaagatcgcccacacaatggctatccttaatcaacaatttacgatttcatggtgggccctattaccaatcgccttaatgtttatctgtgcatggcgccacattccagccatcccaaccttatttatcaatatcatcgttacagtagtcatgatcttcttccaaaagccaggaacctctcttcaatccctcgctaaattaattagtgatggcttcgttgctcacactagcgatgcaactgttaatacgctgcttacccgtggtgggattagcagtatgatgggaacagtttccctgatcatcgttaccctttcgcttgggggaattttgatgaagtttaacattgttcagtcagcaatgaagccgcttgttgaccaccttcataagcctggtagccttattactgttacaattctttcgggtattggaatcaatctttttgttggggagcaatacctttccgttattcttccaggtaaggcatttaagggtgcgtttgataaaatgggtctttcaccattagcccttagtcgtgtccttgaagatggtggaagtgttattaactacttaatcccatggggagttgccggatcattcgccgcctcaacccttggtgtaccagtccttcacttcctaccatttgctttctttagtctgttttcaccagttttctcaattttaagtggagttactggaattggtttgaagtggcaaaaaggaaagcaattaaaaggagcgtaacaaaagtcattcataagcttgtagtcacgatgcacattttagatatgaacttcatctgttcgcctcctgcggataattgaagcccattatactgtgaactattaattctcttttaggtggtattattataaacacttattcatacaacgtgttattttttattaccactaacttctacactaaacgaaatacagaatataaaaagagtgacaactaagtgtccgtcttagttaccactcttttttcgtacatttatttcattgctattgtataaatgtaattactttaagtacttttctggattgcctaagagttcatcaatagaaactttcttaccttcttcactgctgtccgattcagtgaagtttaattcaatttcttttgataatatttccttatcaccaataacggcaaagtacctactgtttcgtcgacttgcttctttaatctgagttccaacctttaatccttggtagtctttatcgactttaattcccatggtgcgaagtggctccattaattcaaaagcaaaattatctgctttctcacctaccgtaacaaagaataagtcaagacctggttgtggaatgaagctcttattttcctctcttaataagaggaggagacgttcaaccccaattccatatccaataccaccttcatcaggtccaccgatttgcgaaatcaatccattgtaacgacctccaccacaaattgtcgtatagccgccaccaaatactggtgaattagacatgatttcaaaaatagtgtgagtatagtaatctaatccccgaaccatttcattatcaacaacgtagtcaacattaaatttatcaaggatttttttaacagaatcaaagtacttggcagaataaccactcaatgaatcaagaattgaaggagcatttgctacgatcttcttatctgtttcatctttactatcaaggacacgtaatgggtttttgtagagacgttccttagaatcatcactaagttcatcataatggggttttagataatcaattaaagcttgacgatagttatctcgggtttctttatccccaagggtgttaatagcaacacgtaattccgtaatgccaagtcgcttaaagaacatcaatgcttctaaaataacttcagcatcaatttgcggagattcactatttaatgcttcacaaccaatttgagtgaattgccgttgacgtcctgattctggtctctcatagcggaacattggtcccatatagtaaaccttatacggcttagggtattccggcccaaataacttattttgaacatatgctcgaaccactccagctgttccttctggtcttaaagctacatgccgttcacccttatcatggaaatcatacatttgcttctctacaatatcagaggtatcaccaacatttctcgcaaagacattataatcttcaaacattggtgtccgaatttctgaataaccaaattctgcaaatgtattgcgtgcaatattttcgactttttgccatagttcactttcgccaggcaaaatatcaaccgtcccacgtggacgttgataattaactttagcttttgccatatctaaaacctacctttttaacctcaaaaggctccttaacaagtttttagcttgttgaggagcctattattactaccttaatttacactcaccctaaggtaaagtgttccaccgggtaaatggtataaccacccgccggggtaataacgctccccatcacgaaatattttaatattcacaagtaaaatgtgaattgaagatgtttctcaaatcaataaaagacttagtcgactaatcttttgaagaacaaaatattaataattaatatatgctcttaacctaaatgataaacaatatcatgaatttgtcaatatcgttttatcaacttttatttcccagctttagggtagactgggttcgcatcatcatattcgtaatgactaatgtgtccatcttgcatccaacgtcttaagcgatcaatttcttctgcatgatcagggtccaacaactgtggaaattctccacgaatagtattatcgtaaccagcatgattgatttctttaggcttaatgtcttgaataaaatcaaaagcacggccataaacaatatcatttaatttaagatcactaaaatcataaaatttgataatcaccttaccgtgaggcgttcccttgacgaattcaaccttctttacactatcctttttatatagtgtcatctcaccattagcatatctatagaagttgtgaattgaagtcattaaaatttcttttccgtcctggccatcatttactataatttgtgatatccgatcttgcagtttttttaatgtcctcttaaatacatcggtaaccaatgtattaggaatgactttattaatccgttgcatgtttatactataattatctgtcataacttaacacaacctaacctataagaagagactgggacgtaggtcttttaactgttaaaaagacttacatcgtggtacacaaacagcttcaatcattcgtgaacgtcgaacgattgaagcctatttatgcattgcaaatgcgtttctacaaagtcatgatcgacttttgctccacatccacctaccttataaaggccctaatatttttggaagggaattaaaaactgtaattaatttatattagtacttaatagcgccgttagcagttaacgacttatatcccatcttatcgagccacttaggcattgttaagttttccataatatccatgtcagtatctggtgttaagattgaaccgcctgggatagaatcaaccggcattgaaacgtaaggtgctacggtaattgcattaccaatttgacctggttccatcattgcatgagcaaagccgatccatgaacccttgaatgaggtattagcatcttgaccacactcagcaattgacttagcaattgccttacgacgacccttaaggtattcaattaattcatcttcattaggtgtttcccatacaccagcatcttcaataaacatactcgaatcttttgcaggatccttagcgaatgaaagagcaatggctgaccatacaccatatccttgacccggtttcatgtctgaatcattcattggacgttctgcagtaacacccttattagcacaaacaatgaatgaacctggagctggatagtgacgacggttatcgttagtgccaaagtattcaactaaggaatcttgtaatggtttagcatcatagattggaagttcactaccatcccattgctttacagtaaacagtggttcagcagtatcaacttctggatttctcaaaagatcatacccaatgcaatgaccttgaggaccagtaaaagatgatgcagtggtcatgttaatctgaccaatgtaagcattcttagtttctgcacggtcataagaaacaattccatctaaaacttcatcatctgttttgtcacgaacaccagcatcaaccttcaaaccagttacataaccattaccaatattacctggttccatgtaaccacgactccattgcttatatggactaattgcaatacggtcaacgccaagtttatgaagctttgtatctaattcggacataattagacctccattaataaaaaagcaaaagttacaaaacaatagcaatgaacgaaagcgcttcctattccttacaatccccagtatatatatatatatatgtcaataggaaacggtaaatttttctaaaaattttaaaattaaaatagatgattatataaaaaacgccaaagactaatctttgacgcttttttctggtcatatattgtttttttaattaattaagcacacaaaatgttatttttagttaatatatttagtgaattaatgcataaatcccataaattgcaactaatacaattacaattgcaaaaatcaattcgcccttggtaaatatcttctttccatgttgatgacgtgcccacatatatagcggaataccgacagcatagaaaataaatgaaattaatgtatatttaatatttgccgagtatgccataaataaaatatagaggaacgctaagacaccaattgccattcctgctccacgccggtgcttggtatccgtagggaaatccccatgttctttacggcttattttaatcaagtacatcgatgagagtaagtatggtgggacagtcataactccaacaattgttaagagcatttggtatgcactctcatcaaagtgagcaatcaaaataataatttcgataacaattgtggcgataataattgaaaatactggctcaccagtctttgataccttagcaaaagcccgagggaatgatccatcttccgcagccgcatgttgtggcaattcggctagcatttgaatccaagaaatccaacttgcgaaaacagcaactaacaatgcaattgcgatgacatcacgcccaatattattatgccaaacattagtcaaaatgtaagcagttgacggtgaggtcatcttggctaattgtccataagagtatgcacctagcgaaagcataccaactagtgcgtacattaccaaacaaacaacaaaaccaataacagttgctggtgcaacttgcttaacgttttttgccttaccagacataacaacggcaccttcaataccaccaaagagccacaaagttaccatcattgtgttcataacttgatgcattacactacccattggtttatcactaagcgagggaacactgtgagtagcgctcatattagtggtaaaagtgtgaacgttaaagtgaaagagtacggaaacaagaaagactactacaactgctaacataatcgcagtagcaattttttgcactgtactagaaacttctaccccgcgaagaaccagagcagtaattgcccaagtaataattgaggccccaataactgatggccagttattaccaccggtaaatgtacctgggaagaaataatctaatgtactcattactaaaacagcataagccgcattagctgcacattcacaaacaaaatacgcccacgcactaaagaatccggtaaatgagccaaatccaacctgcgcatatttatatagtccagcggttaaatctggcttaacatcactcaaaataacaaacatttcagcaatgaaccagatcccaataccagtaatgatccaggagataatctgagcggtaacccccgcttccattgacatattcttcggcaagtcaaaaactcctgaaccaaccattgcactaacacatagcgcaattaaaccaacaagtcctagcttttcagcttggggtttattatcggccattttgtacacatcccttacgttatatttgtaaggaataggaatatgcacaatgtccacgttcaatatagcacttgcattttaattattcaacagcagaatggttgccgtatctgtcaagttttcataggtagcctttaaatatacagttttagtgggttagtgccttaaaaagttgtcccattggtctacttgtggccgtgttaatcggaattattccttgtactgctccaattgacggctttgtcggtgcctttcttagaaactctccagttcgaatatgcatttcctgtaataggctggtttgagccactcgaggaagaactgttaattgttctaggattgtatttaaactagcttgcagttcaccattcattcgggcttcaattaaaccaatcatggctttagccccctgcttagtccatgacttgccctgtttcttcatccggtaagtaaaagcccggtgagaactttcgactgaaccaattaaatgaatatccttaaatccacgcatttgtggtgagaggatataccgccaatttcgctgtagatactttcttaaacgcattaggtcgtctgcttgtttttccgttaggttttgtgattctcataagtatctaaaattattgttagctctgcttgatcatgatgacgaacggctttaattgctcgcatggctaattcgttgtgccgccctaaagtatgttcaattttctgtaaacaatgatagcggtcgagaaagtattcaccatgtgcaccttgaggaactagacttaatagcttagctggttcgtaacctgggccagcgtcactggccaaaaagatcgtttgaccggcaagcttataatggcggtctaaataatcacttagtcgtgcttcaagccgtccttggtgcccaacactgagaaagtcatgccgattaatgatttgattagctactcgctcataaacccgataatggtgcacaagagtcagctgacctgcttcttttttacctttaatcataaaggcatcaccctcaatagttaaatttttaggcatatggcgaggggtagcttggtgttcttttgcttgagtttgtttagctacctgatttcctaactcatgcacggcgtgcattaccgaatcggcagtaattccgctgtcaaatacaaggttcaaaatgtcggcagtattgcgcattgtagttgtttggacaatcttagccatcatcattaagtagtgtggcgataaacgacgacgtggtttaatttttaattgttggtctaagtaaaattcacgtttctttgtcccagcctgataataccgtcgttgaaaagtcaccgggccaaagataaaattaagcgtccgtggctgtttattgattacttgatagttcgctggagcttgggactttaagctttgatctaagctttccaaaaagttttgcatgattacttgtcctaactccaataccccttttaaaataatctgttcagcttcaaataaactgcctgatttcaccaaattctgctcgatttctgttaaaatatccatgaggaaagacctgcctttgcttagtattcgacacactaaaggctactggtcttttctttttttgtaaataagtaaattggtctacaaaaaagatttccacgaccagatgaattattcatccaacctatgaaaatcttacactaacatggttgcccttacattttagagaattgggatgcatggatttctaatcatataaccacccttacaatagaaagtggggaattaactattagttctctgttttaaatataaaaatccgaactataattttcatatttcacgaaattatagttcggattttccttcctaaatagctttaggaatctttttatttactacttttatcataacaatctaaacaacataaaagtctttggtaactaataaataccaaagcttttcactatcttattatcctgcaattaatacttctgttaccaacaatccaccaccaaagattaaaacaaagacaactaccggccacacgaaccgcagccaatgggaatatcgcatatcaagcatttgcaaagttgccattactaatccagtcggtgctaagaataacattgcatattgaccaaattgatatgcagtaacaactgtataccgtggaatgtgaaccgtatcagctagtggcgctaaaattggcattgctagcactgctaaaccagatgatgatggaacaataaagcctaagacaaagaataccaacatcatcacaataatgaaaaatgatccgttcatatgtgcaaccatttttgaagaagcatagagaattgtatcagaaatatagccgtcattaagcactttattaattccccgtgccaaaccaataattaatgacacaccgactaaactagctgctccatcagaaaaagccgttgtggtcttatattcgcctaaaccgtcttggcgcccgaaacaagttaaaaatataataataatagcaattgttaagaaagctgatgccatgttaggaaaggcccatcctttggccattactccccaaatcataattgggaaagcacaagcaaataaaattaaaataattttcttttttaaagtaaaccgctgatctttttcttcgctagtagccattccccacatttgatcaaatttatcccgatcatcatatgaataggaaaactgtgggttctgttgtactttgcgtgcataccaatgcagataaaataataaacaagtaactgcaattaccaagccaaaaatccgtcctgccattccttgcgtaaaagttgtcccagcagcatttgacgcaataacaaccgaaaacggattaatgactgaaaaggttgttccaagtgaacttgccaagaaaatggccccaacacaaacaattgaatcataccccatcgcaataaaaactggggctaaaattgggtaaaaggcaaccgcttcttcttcaatcccacatagcgttccaccaagtgctagtaaaactgtcacgaggaataccaaaataaattcttttcccttagtcttggtagataatgctgctagtccagattcaaaagctccacttgctttaacaacaccaatcaaaccacctaaaactaagataaaaatcataatatcaactgattcaattgtaccatcaaccatactagagaaaatatcgctgaccgaagccggatgctgtgcaagccgtttataagttcctggtactgaaattggcttattaattgctcctgatttaaactggtcgacatcaatttgaatgtgcaatttatctaatgttgcctgtgtcgcaggataactaactttttctccagttggttgcgttacttggagatgattattaacatatgctagcttagaataacttcccgctggaacaatccaagtaagcattactgcgatcactgtcagaaagaataaaattgtaaatgcacctggcatttttaacttaaaccgatgctttttccctgctgttgcttctcccatcattctcactccttaagtcttctttctcccttctattaattttagcaagcgttttcaacaaacttcgtaataagtcagattaattcaacaaatgcatatttattatttaaaaagcaggttaaacccattagatttacctgctttttagtatcttcacctttattacttaggctacttattatattcaacaattttcatatcattatcagtcagcgttgcacgcgtcagacttccatttgctggacgctcagtcacatcatactttccatgaccaaaacgttcgactaagcttaaaacagtattcccatgacttacccataaaacatttgcgtcgtcaggtaaatcagcatttctaattaattcaatgcctttatccattcgttgccaatactcttcattattttcggcatcatgaaatggatcagcatcctttaaccagtctttggcttgaccgatggaatatgcggttacaatttcacggaagttcttaaagccatgaggggcacccgcgttgtaccaagcaaggtccatattcgttccttcatatgatccataaaactcttcccgaaaataaggcgcggtgactggatgagctacagaattagcgttattaagatttaaaatcacttgtgctgtttccatggctcgggaaaggtcactacaaaaggcaccatcaaagtgaatattttgcaacttctcaccagctacctttgcatcttctttccccttcatagttagtggagaattactccacccttgcaatttattgtaaatattaaagaaagtctgtccatggcgaacaagataaatattcaatttagtcataacaatccctccataattttattgtaccgcttacaagtccttaaaactatttaagtattaactttgagctttaaacacatattcttcatattctccacgtagactaaaaaatatagaaggaaggaattattatgaagcttagagacactagtcaaccaaatattgttgctgctaagattattaatgttactccgaaaaatgttaccgtaattactgaagaaggccacttactcaagattccattaactaaacagtatcgggaagacaaaactttacgggcatcattggttgatatcttgaaagcagggatatggattccagtaaataaaaagctaaaaaaattatttagttacgactggctttctgctcctgccttggtcccagcaaagaattaagtttcttcaatgatttccataaaaagaatgttttatagtaatctatgataaaataattcttgatttgtcgaaattgcacttcgataatatagaacaaaccatattgattgcgaggaacattcctaatgaaaaaattaagcaaatttgtggatactaggattggttttttcaccctcctagttatccttttttggttaaagaccctgtttgcttactttactgactttaagcttggcgttacgggaatttttcaataccttatcttaatttttaacccgttagcgactaccttttttatttacagtttagcattctactttaagcgttcgcggttcttctacccggttattatgggcttagacattgcgaacacattattactctatttaaatgtcatctattatcgtgaatttaccgattttatgacaattgctacgatgactggttattcaaaagttaatcaaggtttaagtggtagttcacttgccctcactaacttccatgatgtcttttactggttagatatcgtcgtaattcttattttaatgctctgtaaagttatcaaatttgatccacgagcaattggaacacggttagcattcgcatttagctccgttggtcttgtcttatttggggttaatttgtcttttgcggaaatgagccgccctcaattgctcagccggacattcgatcgttcttacattgtaaaatatcttggtattgatactttcactggttatgatttagtaaaatcacaacatattaataatatgcgacaaagtgctactaaacctgaactactaaaagttaaaaaattcaccgataagcactacgctccggctaatccccaaatgtatggaatcgccaagggccgtaacgtgattatcatccaccttgaaagtttccaacaatttttaattaacaagaagatcaacggtcaagaagttaccccattccttaactcactttataacggcaaggatacctactcgtttgataatttcttccaccaagtcggtcaaggtaaaaccagcgatgcagaaaacctcttagagactagtacatttggattgccacaaggatcattatttgccacgttaggaagcgacaacactttccaaggcgctccagctattcttaatcaacgtgccggttacacgagcgctgttttccacggaaatgtcgctagtttctggaaccgcaataatgtatacaagaatttaggttaccaatacttctttgatgctagttattacgatacttctggagacaaggctaccggatatggacttaaagataagttattattcaaaaactcaatcaagtatctccaaagtttacagcagccattctatgctaaatatatcactgttactaaccacttcccttacacgcttgatgacgaagataaggatcctaacttccaaacaactaatactggggatagtaacgttgataattactttgtaacagcccattatcttgatcaatcaatccaagaattctttaattatcttcaaaagactggacttgataagaaatcaattattatgatttatggtgatcattatgggatttcaaacagcgaaaatacttccttagcaagtgttcttggaaagagtgcagatgattggactgactttgataatgctcagcttcaacgtgtaccactaatgtttgtcatccctggtacggggcatggaaaggtttaccatacctatggtggagaagtggatgttcttccaaccctccttcacttgttaggaattagcagcaaacgctacattcagtttggaactgatctcttctctagcaagcataatcaagtagttgccttccgtaatcgagattttgttaccccaacttatactagtgtgggcggaacaatctacagtaataagactggtaaagaagctaaacttaccaagaagcaacaagagaagttaaagaaagatcaagagtttgtaaatgaggaattgactctttctgattcgttaaacgaaaagaatctcttgcggttctaccatccaaaagggtttaaaaacgttaacccagctgattacaattattcaaatggtctaaaacgagcacagcgaattgaaaagaagaagggaattaaatcaacaagtatttactcagaaaatggtgaccgttcaactgtagatgactacagcactgacgcccctgagcaaaaccactcttccactgattccaaccgtattaagattactaatccagatgcgaataataagtagtaagggtacaaaataagtatagtagggtctagcagagcactgtgttctgcctaggctctattttttaagtttaagctaatttcaatcaactaaacttttcctccagtagcaaaagtgatattgttaacttatacacaaagaataatggagggatttttatggttgaagaatttggctcaccatcgtcttacatccaaggaaaaggtgtcctttttgaaagtgataagtatcttaaaaactttggcacaaaaccgttattattggctggcgaaacagtctataaaattgtaggtaagcgttttgaacagtatcttcaagaaagtggttatgatgtcacccgtgttcaatttaatggtgaatcatccactaacgaagtaaaccgggttacagaaattggtaaagaaaataatgtaactgtcgtttatggtcttggtggtggtaaaacagttgataccgccaaagcaattgccgacaatctccatctaccagttgtaattatgccaacattggcttcaaatgatgcaccttgttctcgtctttcagtaatctacactgatgacggtggcttcgatcattatcgtttctacaaccaaaaccctaatctggttttagttgatactcaagttatcgctaatggtcccgttcggatgcttatttctggaattgctgatgctttagctaccaatgttgaggcacaagcagttgctcaagctcatagtgatacaatgcttggtgaaaaacaaacccttgttggaaatgcaatcgcccagaaatgtgaagagacattatttaattactcgcacctagctgtagctgatgcagaaacccatgtcgttacaccagcattttctaatattgttgaagcaaatacactaatgagcggtctcggttttgaaagtggtggtctatctggtgcccacgctattcatgatggcttaacaattttagaagagactcatgatttaacacacggtgaaaaggtcgcatacggtaccttaacacaattaatgttggaaggcgctgaccaggaacgctataacaagtacttccaatttattctttctttaggcctaccaactactcttgctgatctacatttagaaaatgtcaccgatgaagaactgctcaatgctggaaaagccgcttgttcagaacaagataccatggatcgtttgccatttaaggtaactccagatgacgttgctcaagcattacgagcagttgatgcatatactaaacaatatttaactaatcatcgttgtcaccatagtcgtatgtaataaaagggagctgtgacataagttaggtcacttccataaaaaacgaacagcgcagtacaacaatggccttcagtgtccggtaaagccgaacactgaaggcctattgttgtttgcgggggctcgaaaacgaagtcacaagtgacttctgtctcgctcccttttgttatttaccccataagaaattaattaatgccttatcaacttgagcattattatgaagtttcgaatgttgagcatcttttcctgttatttttagaacacggtatgactttgcccgagcagctactaaatatttaagtgacaatgatgaagcattatcaacagtaccgtctgaatgattaccaacatcaccaataatattaagaaccgctacttgacctttgggataagtttgccggacctctgtcatttgacgatatgtggcgttcatttcatttggctttccgtctttatttaatttcattccaactggttgctgaatagcagcaggtacctgtttaaaattcaatcccgcaaaatgacctgcaatatcaacctgtttttgtaattgaggcatattctgatttttaccgttttgcaacatatagtaaataatcgaaatatttcccagggaatgaccaaccatattaatcttagttatgcgatagcgtttctgtaatgcctttacaacatttgtcgcatattcgccatgcttattaaaatccaactgcctattgttatcataattcacctcaacaattggattgatggcccctttatgcattgaaccatgaagagtaacttttccgttattagcaacatcagctcgcaagactgtgctcgttaccccagcttttttagcagcatttaccatgtgttcttctgcatgataactactgcctccaccatggaaaaataacgttggcgttgttgattgcacatacttactatgtttttgctgacgccaaactgccccaccaattattgccaggataacaattactatcactataccaatcccaatatggctttttttcataatttcacccgcttttttgtttacttagattataagcctaagaacaataatgcagtcaaaacttattttaatgcaggagacgttgccaaaagtttccacgacgaacatcattagcactatatagagagtaagttaatggttccccattaagcgtttctaactgatcactcgttatccttaaactgccgacacgttcacctttccaaataggtgcttctaattttttctttttatattgtgttccaattgtatagtccgtttttgtatcatacggactccaaatagttacttgttgtggcgtgagtttcattgttttttcaacaccattagctactttacgtgttgttactgatgatggaacttttattttttgtaaatggtcctctgttttaaggatcttatataaattctgagtagccttaaatcggttgtctttattgcttccttttgaatgtaagataacagtaataatgcgatgtccttgatacttacctgtacttgcaaaacaagctcccgcactgtcagaagtccccgtcttcaaaccatcaatcgttactccttttacagcgtactgctctcccggtaacatcttattaagatttttttcagtcttaacttgatctttcgctatttgaaattttacttctttttgtgctgtaatttgcaaaagttcaggataatgtgtcacaaagtattgcgataaaatggcaacatcacgtgcactcattgtattagcagcattattaggaagatcagctaacttaaaacttttcatatctccattatctaatccaactgaattaacaatgttggtcttagtcattccaattttttttgctttttgcatcattttaagattaaattcatcggttccatccccggtagcggtcgcaagtgccacggtagctccatcagctgactttacaagggctgcattgattaatgtccgaactgaataagattgaccagattttaggccgattgaagaataagcagcatcattagaaatagccgcaatttcaggagttatttttacttgagtatcccacgaaagctgcttctgttggatttcatcttctattaccaaaatagttaataattttgtaattgaagccaccggaagagccttatctacattttgcttatagataatttgccccgttgaagcatcagccatgatcgctgcagaagcatcaattcgattatttgctaataccgattgacttcctaccattagcatcatgaatagagataaaataaaaactgtcaattttttcataaaatctattctcctattttctccaagtacggtaagataaacttaataataaataataaaggaattcattatgaataaagaacttaaatctctgcttttcatctcaactggcctattccttatttttgttctaatttttaatctttatacatataatgctgctagatctattccccaagctagcaaaacaagccaaattcttaaccaaaatcgacttcgcgcccctaacatccaccgttcctcggaaaattgggcataccctaagatcgataacgctcctattgaattggtcgccgtcaaacaagcaaaaagaattctagttatcaactcaaataagcgacaagttatttacatcatccacgcacaaattaatttaccagcacaaaaaaattcttttcgcttacttcatgctcggggacagcaaatttatcacattaatggttcccagcaagccatcgctaagaactggttaggcattaatgatgggaactacattgaaacccccgttacagatatgaataatcatcaggtcccacgcaatctacgaaaagcacccaagatcgaaaacactatccaagtgtcaacccccgatgctaaatggcttcaaactttgcctgaaaatacacccttaatagttaaggaggactattaatatgatttcacgattaaaacatggacgtttttttaatcacttatttggaagtaatcttattttactaataataattatcttttataatcttcttacatacttcatcccattaatcaaaatttcaatcacgcaaataatttttttctttctaataatcgatctgttcttgattatctttaaaattttagcgctacaaaattagccgacaatctcaatcttagtaccgactggcaaattcttttccatccattgtgcgtctggcactgaaagccgaatacacccgtgagaaccctgtgtttttccaagtttagcagcttcttgttcattatattttccgtctgctttagtcggaacactatggaacaagtattctccatgattcttccaagaaacgtagtaattagctccctctttcaacgattgattgaagaagctatctcctcgctcttgttgagcataaaatgttcctgtcggggtcacacttttcagcttaccagttttaggatcttttttataaattccacctgtgctatacattgtgtaaatgacttttgaaccatcatacaaatatgtccgattattctttaagtcaactttaatccaaaagtccttcaccttattcaaatctggatacggaactgtttccgaggacttatgccaatcaattggggttctcatgtgactttcgctgttatcgatttccttttcttgtgttggcttttcttttacttgcgattcaactactgcttttttgggatgtgcatttgaagcagcatgtaattctggaccaattgcaattattgctactaataagcaaaatattccataaatccaatgctttactcgtaagttcaaattaatttctcctttacagataattcaaaacatcactattataattatagggaattttttattcaatatactttaaaaaaggtgtacaaaatgcgagataatcttaaagtttcatacttaactgctatctttttctttattgttgctatcatttatgcaaatcttgcgtaataatcgtgaggattctactatgacatcatttttttcattcatatcaaatatctggtcgtatatcatcaaccataaatggtcaaaggatattttaagagccaacatcctttttattcttttagttattatttatgatctttttcacttttcattaaaaataattagttggcggatctttttcaaagtatttctgctattaaatatttgtttgttttttaagtttcttttagatggcattgatcgctatttaaggacacggtaactttataaattctttattgagttatcaattttccgtgctaagataggaacgtaattatttattttcgatttgaggaaggtacaatgcattcatatattaaatactggatagcaggaataggagcattattaattataatgattgcggggatgactgttcaccagaaaaatcatttcaacaaaaacgtaaccatcaataatgttgccgttgggggactaacagccaagcaagcttttgagaaggtaaaggggacctcaggagccaccaaggtatatgttgacaataagctagtttaccaaactaaatctatgaaggctaactttagcaataatgatgaacaaaaatttaatcaagcactgaaaaagcagtttacatttttcccatctcataaagcaacaaacttatcaataaagccagataactttgatcaagattcgtttaatattgcgaaaaacaaattaactaacaaggtatatcaactcaacacaagtcgtaaagctcccgttgatgcttacgcggtctaccaaaatgagaaagtttctgtagttcctgcagttaagggtaataaatatgatttacaaaacgctgttaatcaactaaataatcaagccggaagtactaaaattaatattactttacataaggaatagccgattgcggcaaatagcaaaaccgttaagatcgaggaaaaacagttaaataagttaaaaggaaaggaagttacttacctcgttcaaaatgaaaagtataacctcactaccaatcaaattattacccgggcaacttatcaaaacggcaagtatcatttcgacactacggccttaaataaacaagtaaaaaaaattaatgagaaacatgcaactcttgataagccatttaaatttagaactcattctggagcagaaattaccactacagctaatggttcctatggttggaaaattagtgagaaaaaagctggcaattcattaactaaagcaattatcgatggccgccaagaagttgatggcgagcacgatattgaaggaaaaggctataacactgctggactcggctacaatgttacatccaataatggtattggcgacacttatgctgaggtttcattagctgaccaacgagcttatttctacaaagatggtaaatgtgtccttgaaacagatatcgttagtggaactaataatgaaggtaacaaaacgccaaagggagtctggtatattatgtaccaacaaagtccttctgttctccgtggacaaaacgatgatggatcaagttatgcaagtaaagttaattattggtcgccgtttactttaacaggatgtggcttccacgatgcaagttggcggcacaattggtccaagactgcttacctaagcgatggttcgcacggttgtattaatatgcaaccaagcgtggcgggacaagccttccatgatttaaaacaaaatgaacccgttattatttattaatgctctagggggctctagcgttcggtttccggacgttagaggccattgttgtactgcgtatttgctttttatgaaagtaacttaacttatgtcacagtccctattattttaaaagaacacctaaccggactgtggtgaaaaactcgcaagctagcttactttttattctcttaattaatatatacgtaaaaaattctcctttgcacctcataattctaaaatagtggtacagtaaaaatgtatcttaaccttaggaggcttagattatgactgataaaattgttactgcagaagaaatgcgacattacgatttttacaccattaatacaatcggtatcccttcccttgtgttaatggaacgagctgccttagccgttcgcgatgaaattttacatgcttttccgattgcgctaaaagatgtggtagtagtagctggcagtggaaacaatggcggggatggaatagccattgcacgcttgcttcatattgctggtgtccatgtaacaatcctcaatataggtaatcctcagcatgcatctgctgaacaccaaacacaagaaaaaatcgcgcaatattatcaaattcccgaaacctctgatctcgctgtccttaataaggcaacattaattgtcgatgccatgtttggaatcggaatcgatcgtgcagtaaaaggagcttatgccgacgcgattaatgcgatcaataacactgatgcggttgtcgttgcagtagatatgccatcaggagttaatactgatactggagaagtaatgggaactgctgtcagagctactacaaccgtaacttttgcctataataaggtcggcttaaccaagaatgacggaaaagattacgcaggaaatgttgtcgttgcaaatgatatgggaacctatgcagtagactgattggaatattatttaccgagccgttttactattaatcgctgaatattaatattattataataagtgacgaacgtttcagtgaactaatttggaggtaaataatatgtcagagttaacaaccaaattatttatagatgttaaaaattttgaaaaataccaatcaatgttaaagtgccaagtacacattgaagaagaacgtcatggtgattattgcttaccaggttttcctgatcgtcacaatttccaccgtcttctccggattttacgtaaacatgatgacggtttaactagcaaacaactaatttacgacttcgattaccggccaagtgaccttgaagatgctaccaaggcattagtaacaaacaatttggcaaataccaccccaattaacgaggaagactataaaattcggcttaacactgagggtattgaagttgctgataatttgctaaagcgtcgtgacaagattgctgaagctgcttaccacacattaagtgaaaatgaacaacgagaattagaccggctcgtaaataagctaactgaggattatgcgaaccgcgacgtaaattacaacgcccttggaaatatttgccgttaaaatataatatcctattcaaaaaaggcagaggctaagagaattcgttctatgatctcttagtttctgcctttttagtagcgacaagtcttattaagaaagtactttcccgctcactttcaatttagttatttcaaatattctgccggatttgctacaaaatcgctcactttaatagttgttgcatccttagtagcagcattctttagttggaaagttccttcttcaacttcacgagcaccaaacactgcaaagtacttcgcattacgacggaaagcttctttgatctgcttaccaacttttaccccgctgtaatctttgtcagccacaattccttgctgacgaattttactgaggacttcaaatgccatttcatctccttgctgatctgcactagcaaagaagacgtctaattggtcttgaggagcaaatgcaggattttcttcttggagtaagagcattaatcgttcaacacccattccgaagccaattccaccttcttcagggccaccaagctggctaatcaacccattataacggcctcctgcacaaacagtcgtgtacccaccaccaaatactggtgagtctgacataatttcaaaaatagtatggttatagtaatctaggccccgcaccatattggtatcaatttcaaaatcaattcctaatttatttaataaagcctgcacttcgtcaaagtaagcttgtgattcttcatcaaggtaatcaaggattgatggagcttctgcaacaatcttcttatcaccctcatctttactatcaagtacacgcaatggattcttgtataaacgttcttgagagtctttactcaattcatcatagtgaggcttcaagtagttaattaatgcttcacggtagtcttcacgaaccttcttatccccaagagtattaataactaatttaacatttggtaccccaaacttcttaaagagcgccattgccatcgaaataacttccacatcaatttgtggtgactcattgtttaatgcttcaaccccaatttggtgaaattcacgttgtcgccctgattgtggccgttcataccgaaacattggccccatgtaataaactttataaggtttaggatattctggaccatagagcttattttctacataagcccgtactactccagctgttccctcaggacgcaatgcaatatgccgatcacctttatcatgaaaatcgtacatttctttttcaacaatatctgaagtatcgcccacatttcgtgaaaaaacatggtagtcttcaaacatcggtgttcgaattccacggtatccaaactggttaaaaacttcgcgcgcattttgttctactttttcccaaatgcttgtagttcctggtaagatatctgcggttccctttggcttttgataatccatatgtttcccctttcgttacgtataaaaacaaaagccctctaagactttaacagccttagagggcgatattcatcactgttccacctctattttacagtaacctcacagtcactgcctcatggagttgcgttaactcctgatgataacggaatcaccggaacagactactaaaattcatcctttcagctagtagaggtggatcatgtctgctcccagctctcagctcaactgggtctctgtcaattacacaggcactttgtttctacgtcaatgcttttataatacattagtgattttaccatagcttacagattttgggtatcatttatccaaattaagccgtcgctgaactcggtgtaaatgccataaataaagacagataataatcagagtaccggtcattagacaaaagactgaaataaataaaaattgataacttcctttttcaatgacaaatccaccgtacaatggaccaatcgcccgtccaaccgacatcataatattaagcagtccttggtaatgcccagcttcatcaacattagtcagttgcgcaatccaagcaggcaagccagcaaaactagtcatttcaccaattgttaagattacaaaatcaataacaaaagctgtcagggtccgagcaaaaattaataagagaaaggataaggcaaaaataaagattcccacaataatttgcgttgataaacgaacatagggacttaacttattaacaagtggttggccgataataattaacaccccatttaatgtccataacatactataggcataaaatggaatccccatgtttgtcatatgaactgccattacactttcccataaagaatagcttaaatgaaccgtaatatagtttatgaggataaaccaaactaagatgatccatcgcgaatgcaattggcgggaatcatgatagtgttcttgtatctctgaattatctttaattgcatctacagccacattaaatgttaaaactactactaacattaacaaggcataaaagattgttgctacagcaaaaactaccactacactaatcggcagaagaacgccgaccagcaacgttccaatcacaaccccaatattaaaggccatataaatataattaaaaacatagcgggaagaatgatcgctaaccaacgtcccataagaattaacaatcgtggcattgattccatcaccaaagctgttaattgtaattaggacagcataccatggccaatcatgaataaagatcaataagaatattgctagtgttgagaggctaactcctaaaatagctgtttgatattgtttccaatggtcaaataaccaccctcccaaataatttcccatcatcatggcaatcgacattattaacatcacaaagccagcagtcgtcagagtttggccaaggtaattatgaagatacatagttgtaagcggccataaaaaagctgcccctgtgttgtttaacagacttgcaagggcaacccattttaattttactgtttgctgttccattttaacgttcagataccatatcagaggaaggtacacgtaaaagcgtataggttacagcactatgatttgcttttaaccctaaaccattaatagcagtatttttatactttacatccattaccgctgcaaaagcatgtcctgtcttggcatcctctttttctaattgctttttatcccatggcaaagcgctcgcatctaaggtaactatccgcgatccatcagcaactgatccataccgtgaatttgttgtgtatttatcatttccagcccagtacgtatatgacacaattgggtgcttgccgcttttactccgggtcgctaaaacataatagaagtcatctgaattatttcccatttgaaggggatgataagtgattgaagtctgtgtttgttgatgattattaatgtcaactggacggaaaaatgtgagatatgacatccccccgagccaacataacgagacaactaataagatcacgtaacggatcactaaatttaatttaaatactttttttgtcttcgcaatcagcattaattgtttaacacggatatagtggattacataacaaaaaaaggcaattgcacatatccacgatagccatcctagccaattccaactcataattttcaatactccattctctaaattatttactatgattatcacacaaattgatccacttgtcgttaaatcttaataacaaacgaataaatttaataaaataactacaaggataagttcaaactgtgctaaactaatttttggtaacaaactgtgtcttgatttagaataagagataaggttagtattatttaataatatacctactaaggaggaatgttttcatggacaatttgagtgagcttgctcaagaattgattaattttgagcgcgaaaatgacttaaatgataatgaagttgctttcggcagtcatttatctgttgaacgaattcacgaaattaaatcatccaataccccagtaacttcagaggaagtcgaattgcttcaacggttcatgcaaagtaagtaacataaccattcatgccattgtggcaaaatcaaaatttaataccttctaaagcagaactaataatatttctctgctctaatctaaaaaaggatctaaaagaaaacatcactttcttctaggtcctttttctgcttattttggttgataaaattcaaccggaacaagtttagtttctatcttttcatgaggtgtttctattcgcttcattaaggtctcaattaattcttgtgccaacaatgaaattggttggattactgttggaagataaggcgctactttccgaattaatcgcgagccatcataacctgtaataaaaaagtctttatttatttgctttcctgcctggtagtaaagattgctaatcgttaatgcttgaacgtcattagaagccagcactccatcataattaccagggaacgtagcctcaagatccaaatgctggatagctaaaggttcaaaatctcgtttttgtttgttcaaaaaatcaagtgccccttgaattcgattgatggtaggcgaaacagaagtatcttcatccacaattaccgctaagtgttttacatcatgttctactaaatacttcgctgctagttcacccccatgataactatcagctgcaacaattggaatattgtcagcaaggtatctgtcaaaagaaacaatgggagcagtaagttgatgatattcctctattcccagattatgagaacccgaaataatcccatctacttgatttgccatcaacatatttaagtattcatgctctatttccggattttgtgccgatgatgcaataattgttttataaccctttttaaataactcatgttcaagctcatttgctagttctgcaaaaaatggattaattaaattaggaaaaatcaagccaacaaacttagatggtttcccctgcatcgcccgtgccaaggcatttggttggtaattcaactctcgcatcgccgcatggaccttattaatcgtcttttgacttaaagaaccataattatttattactcttgaaacagtagttactgaaacccccgctaactgagcaacatcttttaacttagcaaccattctaaaactccttgattaatttcgtttaagctattccattattatagctcaccatatttgaacaatcgacggttactttaaatataattttaatcgctatttttccacaaatgggttctattacatatgtttaatttatcatttatccaaaaatatttttcatttgataaaacatgttttgtgaagatgataattattgattttatgatattttctcccctgttttaaaggatttcacttgcttttttaccttcaaattaaattgacgctaaagagaattaatgctagtttataggtagttgaatctttagaacttcttaaacttttttgacctttttgatattatttttatttatgaaatgattaataagccacttttaggagtaatgtttaggaatttcaaatataacttaaggagtcactgccaatgaatcgtcaacctaataatgatccatcaacccattttaagatgtataaaagcggaaaaaaatgggtctttgctggattaactgctgttaccttattaactgctagcggcgctgttgctcatgccgatgatgcttcagtttcttctgcagaacctgccgctacaactactgccaatacacaaaataatacaaatagtgtcgctgattcttctgctgtcgctcaaagcacagcaaatagcgcctcaacagaaaatagcgctgcttctaatgctagtcaagctgtcgctagccaagccgctgctacttcagcctcagcacaatctactgaagctaaacaagctgctcctgctactccaaaggctgctagtgccgctgctgcaccgcaagagaactcaacaacagatttaagcgccctccatttcagtaataacgcttcacaacaagcattcatccaaagtgttgctccgggtgcaatccaaggatggaatgaatacaaggttcttccttcaattacagtcgcccaggctatcgttgaaagtggttggggccgttcagctttatcaacccaggcccataacttatttggaattaagggttcctataatggaaattcagttgtaatgcgtacacgggaagtttatggtggccggagcgtttacgttaacgccaatttccgggcctatgctaacaactccgaatcagttactgatcatggtcgctttctcaacgtaaatagtcgttaccgtaacttacttggcgatactaactatgcatctgttgcaaataagcttcggcaagacggctatgctaccgatccaagctatgctagtaccttaattcgttttgttcagacatataacttaaaccagttagatgccgttgccctttctgggaaagttgttacgaataagcaaactgaaagtgctcaaactcccgaaactaatgtaactgtctcaaacactggatactacacggttaaaggcggagacacgttatcacgtattgccggacagtttaatacaactgtaaataaactcgccaccttaaatgatatccacaatgttaaccgtatttatgttggtcaacggctcttggttcgtcaacctgctgaacaacaacatcaacaaacaacccctaagcgaactgaaaacaatactaccactaatagtaatacatacaccgttaaaagtggcgataccctttcaggaattgctggtaaatttaacactacttatactcaattagctcagctcaatcatattagtaaccctaatgtgattcatgtagggcaagtattaacgcttcatcaaactacagctcaaaatactactaaccatcaagaaagccagcaaaataaacaagttactactagtgctaatggcacctacaccgttaagagtggtgataccctttcacaaattgctgctcgttttaataccacaacatctgcattagcttcaactaatcatattagtaaccctaatttaattgaagttggtcaacaattacggattaacaatagtgctagtgctcaaaaaaacacttcatgtcactccaatactaacaatggaaattacgtagtccaaagtggtgattcattatcaaagattgccgcttatcatggcttaaactggcgatcaatcgcagctaaaaataacattcaaagtccatacacaatctttgttggacaacgtttatcactttagtcaagtaattattaaattattatataatataaagcaagaagtataagaaaatctatgcttcttgcttttttgttttaaaaaaattcttttctgttctagaataaaggtaggcagtttattattaatattcactaaattactattagggagtttatagaaagtaagtgatgtttattgtggtagaccgttggacaacagatattccaaatgttaataaaatcagtcaattatttaaattactagggaatcctaaaagattacaattattatatttgctgattcaacattcgatgagcgtttcagaaattagtatgaagttgaactgggaacaatcgggggtttctcaccaactgcaactattgagaaaatataatttagttcaacaacggcgagaagggaaaaccgttatctatcatttagaggatccgcaggtaatgaccttgatcgctgatgtattaagtcatgcagaaaaaatcatctaataatttagtgaatattctttgggatccccccattgaaataaaagaaaggcgtttagaactcatcctaagtcaaacttagacgatgacttctaaacgtcttttcgttagttaacaaatttaatttctaatcgttcatcttccaaaattccttttacaatcaatgacttaccatcatagaactgatgcttatctaaccaaaatccaagatgtgcgtgactataaaacttaaaactataccgcattgcattattcagtttactaacccgtaacacaccttgtgagccatcggaacaagtaatattttgtgattgattattatcatgaacataaattattgtcattcttctcgcctccgtttttattatatcctattttcggactacctaaaatatttttaaataaaaaagcaacaacttcagctataggaaagttgttgctttttaactaatctgcagctaatgcatcaattggattaaggtttgccgcccggcgtgcaggaagcaatgcggcaataaacgaaattacaatcgcaattacaattgcaaagattacatttccaacagtaatttgcacaatattatatttaatcaagccatacagagcgtggttaataataaccgttacaactgcaacaattagcagtgcaagaattgcggaaaacagtccaataaagacagattcagacgtaaataatcggcgaatatctttctttcgttcacccaaggctcgcaaaataccgatttcttttgtccgttccgaaactgacatgtacattgtcacaataatcattaatgccgacacaagtaatgaaattccagcaattgaagcaagaaccgtggaagcaagactaacataagtattaacagttttaaggatcgacccgactgtaatcgctcctaatatccgtttgttattactaccacgaagattgtcgatcttattcgctactccttgaacattgtcaagatttgttacattaacggttacaaaattagcagcagtagcggcattcgctttttgaagcagtgcacgcatggtggagtacgtaattgaagtcccggcactcgcgccttctgtaatccctgctaccttgaagtttccagaaacgggaactggattattattgccatctatccatgtaaatgagagatggatagttttaccaaccatttgcttataatttttggcacttgataattggattgcttgttgctttgtaagaacgatttcaccattcttgggtttatgtccctgcttgattgaattgctagtaattgccttactccaggtacttaatgaagttccgctctgcttttttccattataatcaagctgaaaggcgctcaccataattcccggctggacagacgacacattatcaagctttcgtaaccggtcaatattatggtcactaatcgtcattgattgaggattagccgccatcgtttgtcctaacgatgattgaatttgttcctgggtcatctttttaccagttgtgtttttaaatacggtaattgcctgcggattagcaagagagttaatctgattttgaatgtaaccatttatcccattacctaaaccactaaacaagagtacggcaaagataccgattgcagttccaagcataattaacgaattacgccaaaagttataggtcaaatgtttaaaagccgttcggtagctcgccatcgccggtaaaactcgtggagtaatctctgttgggtcttctggaatcggataaacaggacgcaatctttcatcgccgtcaatttttccatcagctaaatgaacaattcgtgtcccattatccgctacttcctgggagtgagtaacagcgatcactagtttcccatcacgagcaatttcgtctaataatgctaatacttctttggtattctgtgcatctaaggctcctgtaggttcatcagcaataataatttgcgggtcacttgctaatgctcgggcaatcgctacccgttgcttttgccctcctgacaaatggttcggatgcttttttacttgttcacttaaaccaaccttatctaagagttccaacgcgcgctttcgccgttcttccttagtcaacgttgtcatatccaacgcaaccaaaacattatccagcaccgtcaagtgagaaattaagttataggactgatagatataacccaccgtcgcgcgccgatagctatctagttgcttttcctttttatggtcgaggattttaccatttacgaggacttcaccttcaaagttacgatcaaggcccccaatgatattcattaaagtggactttccaccacctgattccccaaggatggatacaaattctccccgatcaaactgcaagttaattcccttaagaactggaaattcctctttatcaagataatatgatttatatatgttttttaattctaaaaaagccattgcatcctcccccttcactatttatttagtccgtttattatagcaaggttcgttataaaaaaggctttttgctcataattctttaacattatttatattattggtctgtggaatttttgcttaatgtaagtttcccatcggctaactcgtaaacattatctgcatattcacgtaaacgtaaatcatgggttacagcaatcaccgcttttcctttctttttagccagatcttgaaataattgtcccactgactttactaaattactatctaaagctgctgttggttcgtctgcaagaattatctcaggatcggtatataaagcacgcgcaatcgctactcgttggttttgacctcctgacaattcagaagggtattgcttgagcagtttttttatcgcgagtttttccaataattcatcaaaagctgctgatgaaatattaccgctcttctttacacgatcaacaagtttaaattgatcagccacatttagataaggtagcaagttatacgactgaagaataaaaccaattttctgcaagcgcagttcatcacgttttttagaagataacttttcaatattaattccatcaattaacacttttccggaagtaggcgtttgtaaaccgcccgcaattgttaaaaaggtactctttcctgatccagaaggccctaaaatcaaatttaattctcccgctttagcagaaaaattaacatctttaagaacatgaacacggctaattccttcgccataatatttgttaacatctactaacttcaattttgacataacatttgcctcccatcttaattcaaggcctgtacggggtcaatcttaataatcattcgcactggtaataatgaaccaatcatcccaagaactattaatcccactgccattaaactaattaggggccaattcataataactggtaccgacattggaattgccacactcgtaagaagggttaaaataattcctcctattacaccactaatcattaggaaaattgattgagtaactgttgcaagaattaagtgccgcgcaggaattccttgagcgcgcataactgcataatgacttattttttgcatggtaagaatatataagaagaccgcaattacaattaacgaaattaccattaagaacccaatcataaaagtaaaggtattattttgtgctgaatatcccggtagcttattaatatattcgttaacagtgtagtgttggagagcgggataggaacttttactaagcttatggtcagaaaagagtccgctagcaacagccgaactatttaatcctctcagttcccgccaaactggtaaactaccatatacgacgggcgcaacactaaatttagcgtcattgacaaaaccaacaatcttatatttctcattttgagaattgattgttactcgatctcctaaatgataaccctttttgcttaaactcttatcaacaacaatttcgttatttcccttggcttgacgaccacttgtaatcttgatcttttcccgggaaataaattggtcaggatctaaaccgataaattgagcactttctttacttgcccctttttctttaagaactactggtgcttgcccaacaagcgcaacattcttttgatccttacctgctagttgatcgcgagtgataatcgattgtccaaggttatcattactatttttgtttagaaaaacagtttccgtaccccactctttaatggcagcatcattttcattttgcaatcccaacatcattcccattaagaaaaacattaagtaactaatcaaaacaatcatggcaacgattaatccgtaatgcagcttttcatgttttatttcttttagtgctaaaaacatattctacctcctactgcaatagtgcagttagtgccttggatagccgttcaattgcttcaccttgtttattgggatgaagaagacaatccttaattgtttcatgacttaaaaccattacactccattcttgagcactatgaattttaatttgcggttgtgtattatcacgtaacaatccttcatttgtttgaaagtgtaaacgcataaaatcgcggtacttgcttccgttgatttcatctacaaaagctttaatctgattaacataatcactcgcagctaaaatgtggttagcccgggtaattggtgtatggatttctaaaattgccacttggtaaagatactgatacgcctccgttaaatccgcaaaatacttataaaatgctcctctggcgattcccgcttgctttacaattcgtgcaacttgagcacttgctaagctatgttgactaaattctgttagtaatgcgttagtaataagttcttttttctgtcgatttaaatttttaaatgttgtacttggcatcttaattcctccaccgcatcgtgacaccgtgtcaccgtgaatgtattttatacattatcatcaaagtgacaccatgtcaatcattagataaaaattataatactgctatttctgcaaattttgcgattgtagcgctttacctaaggcttgatttaattgctaattacattcacttgcatatgaaataaagcataaaaaaagcgaggtgagaaatttatctcgccccgttttcaatagatttaatttttatcttaatctagaattaagcttcttcgccgccaaccttaacgacagcttttgaaaccttacctaatttaccactaacaaaaccttcaacaccatcaaggtctaattcgtgtgagaagagtggtaatgggtcaacaacaccagaagaaagaagtgcaattgagtcttcaaaagtgtaagggttaatgaaggccccttgaattgtaagttgcttttggaatacatcgtaagtgtttactgagaacttgtcatcagggttaccaacaccaaacattaatacttgagcaccacgagctgcagctgcaagtgcttgttcttgagtagccggcaaaccaacagcttcaacaacgatgtcatatgcatcagcaggaatttcttccttagtcgtattgatagtcttaacgccaaagtgcttccggttgttttccaacttttcatctgaacgaccagctaaagtaacttcgtgaataccacgagccttcaagatttgtgcaaataattgaccttcaaagccatcacctaatactaaagccttttggtatgggtgagtttcaagtaagtcaacaccgtgcattgcacatgaaattggttcaacaacggcagctgcctttaatgaaacatcatcaggaattgggtaaacaacttttgcaggagcagtaaagtattcttcaaagccaccgttacgggtaacaccaacagcatcaagatgttcacataattctgggcgttgagtccggcagtacttacattgaccacagtaaatgttagggtctacagttacacgatcacctggcttaacgttagtaacttctgaaccaacttttgtaactacacctgagttttcgtgacctaaaacaataggaggaacagctgatgcagatccaggaagaccagcatagagtgccttatcagtaccacaaataccagcgtaggcagtgtgaattaagacttcatcaggcttaatttcaggttctttaatatcttcaatttcaagttgctttttacctgttaaaacaagtgccttcataatcaaaatacctctcttgtgaatttaatcatttgtcaagtgttagtatagtgtgaaaacgccttaattgtcaaacgtccaacaattatctcacattctttttatcatcataaaacgttaaacttactaaatataaactcaaacaaaagctgatataaaaggcttttgaaaaaaagtaatatttttaaatatttttttcttcactaagtttaagctatttttttgctattacataaatggttttaccatcattttttcaattacataatttcacaaggttttttatcctatttagctttttacatcaagaaataaaatgtttctatatataaagtaataaattctaaatttatatagaaaatttctccagcttttagaaagcgcttaaccaccattaggcacgccaaaacttatctccaaccgctcctcaagatcgtccaaacggctgttataacggcgattttccattgcaggatatatttttttatgttaccctaacaaagtattcgaacttagttaattatgatttccaatctaattaacaaaactcaaacgaaaggtggatttggcgtggacgacacaaagaatcaacaccggaagcataaacttattgaatatgctaacggtaaatcactagaggaaatcaacggaacagttgaagttcctcgtggaaaaggcttctggcgaacattattcgcttactctggtcccggcgcattagttgctgtgggttacatggatccaggtaactggtcaacttcaattaccggtggacagagtttccaatataccttaatgactactatcttgatttcaagtttgattgcgatgttacttcaatacatggcggctaaactcggaatcgtgagccaaatggaccttgctcaggcaacacgggcacgtaccggtaaagcattaggtattattttatggattatgactgagttggcgattatggctacggatatcgctgaagttatcggagctgctatcgcattaaacttactgttccacattccgttgatcccatctgtatttattactgttcttgatgttttagtactgctattattaaccaagatcggattccggaagatcgaagcaattgttgcatgtttgattttggtgatcttatttgtttttgcttaccaagttgccttatctaaccctaactggggtggcgtatttatgggcctgctcccatcagccaaagcaattgcccaacatcctgaaatcggtggtatcactccactaactggtaccctaggtattattggtgcgaccgttatgcctcacaacttatacctccactcagcaatttctcagactcggaagattgatcataatgatcttgacagcattcgacaaacagttcgctttactacttgggattcaaacatccaattatctcttgcatttatcgttaattcccttcttttgattatgggggttgctgttttcaagactggtgctgttcaagatagctctttcttcggtctgtatgatgccctaaacaatacctcaatgcttagtaatccagtgttaattgctgttgctaagtcaggtgtattatctactttatttgccgttgctttacttgcttctgggcaaaattcaacaattactggaacattaactggtcaagttattatggaaggtttcattcatatgcgaatgcctttatgggcacgacggttagttactcggattatttccgttattccggttattgcttgtgttgcaatgacgagcggtgaaaatactatccaacaacataccgccttgaaccttttaatggaaaattcacaggtattcttagcttttgcccttccgttctcaatgttaccattattaatgatgactaacagtgaagttgaaatgggtgaatttaagaataggggctgggttaaggtttgcggttggatttctgtaattgcccttaccttcttaaacctttacaaccttcctgcaacttacgaaggctttggtatttggtcaaaaggaacatctgacgttctcgcttatatcacaatcattgttattcttgctcttcttatctggacttgtgttgaactctataaaggggacaagcggtttgctgctgaaggcaaaggattcggccaacgtgaagctcaaatgaaagattcagttgtagaagattaaaacaaagaactggaagtaaatttccagttttttatttttgtaacgattctttcacaaaatgttcatacttgaacggtatagtatagacaatccctaatataaataaacccctatttttcttctatactatccccctcaaaatagctatgaagaaatacgaaaagtggtcggcccataatgagtcggccattttttaatacatctaggctcaccatggtataataaggaactagatatattactcattaagtatgaggtgaaatcattgaataataaagataataatcaaaataacaataagcggcggcctacacgggttgagctctatgacactcctaagccaggtgaagaaaagaaaaaacgttctttctttaatcgtaagcctaaacagcctacccctaaccataaacacaagacagcatcccctaacaagaaaaagaatccatatggaatttcacgccgaatgtttaaggtcattttaggctgtctattagttgtcttaattgcaaccattgttattttcttagttaaacaacaggaccctgtcaatgttgatagtaatgacactactgtctccaccagtacttcatcacgcaagaaacataaaaagaacagcagtagcagtcataaacatcgttcaaattccaatgacagtgatgataatgatactcaagatacttatagtatttcaacgcctagtcgttcaaatagcacgcctcagacaaatcattcaactaaccaacaaccaactactaactcttcctcaactccacaacaaaaccaaccatcgcaggaagaacaccacgatcaaggcaacagccaacaacaatctacttcacaaccagcaagtagcaattctgggtcacagcctaatcaaagttcgcaaagtactagctcccaatcaaacccgcaacctgcttcatctcaaaataatcaacattaatttggaataaaggggttgtcaattaaagtgggcgtgctataatcaagacaatcgattgaaggatatgcaccttcaaagtcctctacagagagtaagtgccttgagtggaagtacttatgagtgacaatgatggttgtaccaccttcccttattattagccgagataaggctagtcggatcgtgtccgttaccgcaccttagagaggacattactagtgtgtcctaaagatgggtggaaccacgctaatttttgttaattgacgtccctgatactttcaacattgaaagtatcagggacgtttttatttatattaaaggagagatttctatggctcaggttgctgttatgtccccagacggatcagttaagaagatcgatcgggattcacaagaaggtttagaagcattacgtaagctttctgcattaatgttaaaggctgcattaaaacaagaatttaagggtattcgacttggtgaagctgtcgctgacgaagatggtttccacgttgattctgataaagataatcaacaagtttctgctgacgaattaccagctcttgaagatgtaatcaagggaatggcaaagaacgatgttaaggtagaatttgttgaagtacctgtagaggaagcacttgccgaagtaaaagatgatcgtttctcaactgaattgatcaatgaaaatgctaaagacggcaaagtagcaatgtaccaacttggtgatgtcaaagctgttgcagatgatgacattcttttatatggtaacgttgttaaaaacttacgccttctttctgttgctggtgcttactggaaaggtatgtcttcaaatccaatgcttcaacggatttacggaactgtcttctacaagaaggacgcattagaagaagacttaaagaaacgtcaagaagctaaggaacgtgaccaccgtgttatcggtaaccaacttgacctcttctttgttgatcctaaagttggtgccggtttaccatactggttaccaaaaggtgctactattcgccggaccatcgaacgttacattattgaccgggaagttgccgatggttaccaacacgtttatactccagtcctaatgaatcttgatgcctacaagacttctggtcactgggaacactaccgcgacgatatgttcccaccaatggacatgggtgatggcgaaatgcttgaattacggccaatgaactgcccaagtcatattcaagtttacaagcaccatattcgttcataccgtgatcttccattacggattgctgaacttggtatgatgcaccgttatgaaaaatcaggtgctctttctggtcttcaacgggttcgtgaaatgactttgaacgatggtcacaccttcgttacccttgaccaaattcgttctgaattcgctaagattttgaagttgatcatgagcgtttacgaagactttgatattactgattacagcttccgtctttctcttcgtgaccctaagaacgttaagaagtactacgctaatgacgaaatgtgggaaaaatcccaatcaatgttgaaatcagcaatggacgatcttaaccttgattattatgaagctgaaggtgaagctgccttctatggtccaaaacttgatattcaaactaagactgctcttggaaatgacgaaacaatgtcaacgattcaacttgactttatgcttccagaacgattcggactttcctacgttggtcaagacggtaaagaacatcaaccagttatgattcaccgtggtgttgttggaacaatggaacggttcatggcttacttaacagaaatttacaagggtgcattcccaacttggctagccccagaacaagttcacattatccctgttaacgaagaagcccatggtgaatacgcagatgacctcgctaagaagatgaaggctgctaatatccgtgttaatgtcgatcaccgaaacgaaaagatgggctacaagattcgtgaagctcaaacacaaaaggttccatacactcttgttgttggagacgacgaaaagaataacaatggtgtatctgttcgtaagtacggtgaaaaagaacaaaacgaaatgagtcaagaagcatttatgaatgaaattcttgaagatattgcttcttactcccgcgaaaagtaattaagattaaaaatggctttatcacaacttttgtgaaagccatttttttattttaaattttatgaaagtgaaatttttagcataactttaaccaccaaaaataaaccgttttcgaagcattcgtgaagttttggacaacctaaaattaatgattgacactattcatcaaaggttttatagtaataaacgctcgcttctgagccactaaatataataattaatcataaaaaataaaaactatttattttggaggtataagatatgtctactatgaacgatttatttaaagcaatgggtaaagctactgaagaacgtcacgcaagcggtctttcatttgaagttaagactgatgcacccgctggtattggtcaaggtatccttaacgttcgcaagtaattttaaaaggactgcggcataagttaagttactttcataaaaagcaaatacgcagtacaacaatggcctctaatgtccggcaaaaccgaacgttagaggcctattgttgcttgcgagggctcccagaggctagcttcgcgtcgaaaaacgaagtcacaagtgacttctgtctcgctccctttttatttatccttaatagccgaagcaaatataaacataactaaccccagggcaaatagaacacttaatgaagccgcaccaaccgtcgatttaccagtccattgagtaacgattccaacaataaagggaccgagaattgcggaaaacttcccaaggatattatagaaaccaaaaaattcactactgtcatttttaggaacaaggcggccgaagtatgatctactaagtgcttgaagtccgccttggcttgacccaactaaaatagctaaaatccaaaaatcgatcaaagtttctaaccgtaaagcataaagacaaataaagaaataaacgataatgcctagcataataattcgtctcgtagaaaacttattagcaagccaaccatacaaaagtgaaaatggaacagcaattaactgaactactaacaaaaccaccatcagcatcattgtttgaattcctaagtctttaccaataactgttgccatcgtaaaaattgtatcaacaccgtcaatatagaagaaataggcaactaaaaaccatgtcaactgcttatattgattaatatgatgcatggttcttctcagacggcgcaaactatcgataaaaggatttgtcacactgttgatgatgaccattttttaataacggccacgcaaaaataccccaccaaactgcagccagaataaaactaaatcgggctactccataactgtttaggagaccgccaaagcctttacttagttctgcgactaaaaagatgataaaggcgactactcctcctagatagcccattccataaccagtcgacgaaacacggtccatttgcttattatcagctacatctattaggaaactatcataaaataaatttcctcctgagtaaccaatgatcgacccaatataaacaagtaaaagcacctgccaatatttggttggaacaagagcaaggccaattgtcagcaaaattcccaaccaagtaaagagatttagccagcgtttttttgcatgcggataatcagccaatgctcccaataaaggtgcaagtaatgaaataataagcgtaccaaaactatttgcgtatccccacagcgctgtcgagtttgctgcactaacacctgcatgatcagttactgctttgaaatagactggtaaaacagcggtcacaactaaaattccataaccagaatttgcccaatcataaaaaatccattgccattgttgtcttgtaaacttcacaacgtcacctcagtctttaaagatcgcatcaattgcttgtccggcagttggagccggataatgtaatcctaataatttagcaaatgtcggtccttcatcaaccaggtgagcattttcaacagtcgcaccacctttgatttgtggaccggcaaaaatagcagtagtgaagtaatttgcttgtgttggcccgtagccatggacccctcgatagcgatcgtgagttccaattgattccgaatcaactttttcgacaatcgctggcctgtttacctcatcagtgaaatagtatcccggtttggcttcgacgaggaatgtgcacttaggatctgcgccccgtttgatcgccgttgcgttatcatagattcgctcaacgccttcgacaccagcaatcatttgcttaagttttcctcgatccacggcaccacgagtgtaaatataagtttctccatcgcaagttttagcagtgacttgccagttatttcgataagtacttttctttccaagagggtgaagaagtccttgttgcgcaaatagcatattcaaatgaatcatcttatcaacattaatttgatagtgatctcctaaaattacaaagtctgtttgcgggtaagtaccggtatcttttgtcgcttgaattatcttagctacgcgtttatctagacggtgcaatgcttcttttgcttgtggtgatcgaaccccataacggtgacgcatactatccatatcaactaagtgaattaaggttaagtctggctttttatttttaatcgtatcaaccgcacatgctgttacaaaatcgtcaagccacggttgcttaattccgtgccgtaatttaccgtatttcttattcatttcatataaaaataacggactacttgcctttaacgaaaccagtacttgatttgtccaaattcgattaggaaagatttccgcaaggttataatcaatcttactgccagcagtaacaggccacaaaaatgcagcagttgttaagtccttttcttttgcaatatcatagaggggcatcgattgaatatcttttcgataccagaaccagtcaggcgattgccggcgtggctgcaatttagtattgttaacaattccatgcacagccggatactgaccggtaataatcgaagtatgggatgggtaagttaacgttggaaagattcctttaactttttttacccaggttcctttttttattaaattcgctaatgttggtgttatttggcgtaattcgtttaggtcacgaaaccctagtgaatctagcgaaatgacaattagcttatgctgtttcatttgttcatctgctttcttttcaaactcattagctattttaaaataaattattgttaataactagttttgaaagcaattatcaaaagccattctcatcgtaagcgccaaaatttgtatgatagaacggttaacccctattggtagaccgtggattgccaataagttttaaagtgaaatttgattcacagtaatttttaatgtaaaattaagtttcagttttcagtattttatgaaaggaatcataatcatgcaaaatcagttacccaagggaaaagagcatgagaaaactctcggcctcttcgacctttctattctaggtattggcgcaatcatcggaactggaattttagttttaactggaattgtcgccgcggaagattcaggccccgcaattgttttctcttttctgattgctgctcttgctagtggtttaattggtctctgttattcagaattaaccactagtttacccaattcaggaagtgccttttactacgcgtgggtttcaattggtaaatttatggcgttccttgctggatggacgctgattggggtctacgttactacaaccgctacagtagccaatgggtggactgggtacgtacaatcgttcctagaagtcctcggagttaatttaccgcataaattactggttacgcctgcagctggtggttatgtaaacctccccgctgtcttgatgatcctttttatgacgattattctgacacgtggaaccagtgaaagtaaacttgttaacaacttcttggttggtgtcaaaatctttattattgttctatttatcgttgttagtgctcaacatatcaatccagctaactggcacccctttttaccatatggatacaaagggattttcacaggagcatctgctgtcttcttctccttccttggatttgatgcattagctacttctgctgaagatgctaaagatgttgataaaaatattccccgggcaataattttatgtttagtcatttcaacggccctctatattttagttagtcttgttatgacgggagttctaagctataaagatttgaatgtctctgaagctatgtcatatgttcttttagctaaaggtcataaatacgtggctgagattgtttcacttggtgctgttttaggaattatggctgtcgtctttgcattcatctatgctggctcaaatatcatgaagtcaatgagtcgaagtgcctttcttcctcaaggcctcgctaaagttaatgacaaaactcaaagtcctaatcgtgctatttggttagtcggacttcttgcagctgtcttagccggagaattcgatctccattatcttgcattaatcgccaacattggatcattggttgtctttgctttgatttcgcttatcgtaattatcttacggtaccgttatccagaattaaaacgaccatttaaggtaccttttggcaacgttattcctgttctatcagtattgatctgtattgttttattagtaagcatctcactcaatgcttggttaacatacttattatggctggtagttggattaggcgtttacttcttctattcccttcgtcatgccaacgaatttaacttccaagacgaaagtgatatcccaggcaattaaaatttatttctaaattatgatagacctcctacattgatctaaaatgttagaggtctatttaatactatttaacacttcgattttgtcgagttgtttccgctaagtggactaaattagtaacaaaattatgggttttggcttcataattatatcggcgacccagcttaacaaagtaaccattaatataatcaacttccactggacgattatgactcatatcttggtacattgaaggataatgatgcggacagccaactttagagacataatttacactttctagctcttctgctcgcgtattaactaattgtactcctgcacgttcacagacatcatatgcttcatcgattaattgccgagatagttcatcagccttatcaaacgccgcatactcacccattgtaatttcaaacatagtacaaagggtattaacgactgaattaaagaccacttttgccatcaacgttcccataaaatcagctttaagggatggattaaagtttgcttttttgagctctgtcattaacgcttgtgtcttctcatcaggcttttcagtataattagcccaattagtcgttcccatccctcgttctccaacaaattcaacttcgccaggtttagttaagatagttgctactaaggcagttccagcaactactttttcttttgggaaatacttcaataatttttcaacatgtcccattccattcatcgctgtcatcgcatattgatccttcaagaaatgttcacaacgttttaacatatcatctaactgcatttgttttaattcaaagaaaacaaaatcagcatctgtagcattgtattcttcaggtgtataaacattaacgggaacaaggtgtctatttttatgctcgcgagttacataaactcctccttgttctttcatcttgttgtaatgtggtaaccatccttcaacaaaatcgacttcattacctgcttcttgtaatagaacaccaaaccgtaatcccattgcacctgcaccaacgactgtaaatttcataattctctctcctttttatgactataaaaaagcgtccttagattaaacaacttaacctaaggacgctttttgcgtggtaccaccttaattcgccaataattcacattattagcctcaaatgttcaatgtttccattaaacacgtcagctataatgggctgatcccaccattaattactaatttcatcatggcactcaaagtgattttcattataagcaggttatccttttccatcaaccaaggactctctgctaatccactcataattactcttcttttcaacgtgtttttataatcatattttaatttttatctaatttaatactttgaagtgtaaatgtcaagatttattttttgtcatgtatacttgacatttatttgatgcataaatagaatattaaatataagatgtcttatatacacgacaaaaggagggaggaatattgaataatgttaggaagtatcgaaaacagcaaaaattatctcagttggagcttgccaaagaaatcggagtcgcacggcaaacaataaatttaatcgaaaatgataaatataatccaactcttggtctttgcttaaacttggcacatgcgcttcatactgaccttaactctttattttgggaggaaccataatgaaagaatcaatcggtacaaaaatatttaaacaattctataatatctctggtccaatcgacgaatacaaaaaaactcaggcaaacactatcggtaatacggtcgccattatgctttattggtttaacattgccatctctctccttacaataataattggtggtgtaacaaaaaattatttattggcattttttatacttagtggtacgattctcatttttactatattcattgctggtggttatgttatgtatgcaggtcacaaatatcaccttgcagatcaagaagtagagaaaggtgatattcattctgcctaccgaaatattattttcaaaagtttaaaaattggtatcttaggggcaatctttgcatattttcttaatgcttttgttttatatctctattttggaaactttattcgtcaactaagcgatcctagtaatattgttgcatgtattacatgtggtgttacggtcacattattattactccttgtttactaccttcgaataaaaaaagtaaaatagtttcttgacattcatatttcatccgcgtattataatgacaaataaatgagaaacagcttagaaaagatgagtaatcttagaatcttattacagagaatcacggttgatgagaggtgacataagagactaagatgaagatggtcttggagcttcacgaattacgagtattttatataagtaattcacgattgacgaccgataaaacgtctgggtatagcttccattagtgtacctattgaggatagtattgtgagatgctatcaaattagggtggtaacacgttaattaaccattgattaatcaacgtccctaggaaaagtagaaatatttttcctaggggcttttttattgcttcaattcttgaacccatcacaaatagaaaggatcgatttactatgactgaattcactacacgtactacatcaccatttcgttatgacatcgttggaagcttccttcgtcctcaagagctaaaagaagctcgcgcaaaatttgcaaacggcgaaataacacaagcagacttaacagctgttgaagataaagcaatcattaatttgattaaacaagaagaagctgctggcctaaaagcagttactgacggtgaattccggcgtagttggtggcaccttgacttcttctggggattaaatggcgttaaaaaagctactctaaaggaaggctataagtttgcagatgaagagactcgtcctgaaactgctcaaattacgggaaaaatctccggcgaaaaccacccctttgtcgaacatttcaaatttacccaagctcatacctctgatggcgttcaagttaaacaaaccattcctgcgccagcacaatttttagaagaatttcttcgtcccgaaaatcaagctaatgctaaagaattttatcccaaccaagaagatttagatcatgacgttgcaactgcttatcatcaagtaattgaagatctttatgctgctggttgtcgtactctccaactagatgactgtacatggggaatttctgttaacgcctttgctaacctaaagaaaaaagaccccaatgctgatgtatctcagcttgaagcccttcaaaagcgattcttaaaagtaaacaatgatgcaatcgctaatttacctgccgacttaacaattaatacccacgtttgccgcggaaactatcactcaacatgggcggctgccggtggatatggaccagttgccgacacgctatttgctaaggaaaacgtcactgccttctatctcgaatacgatagtgaacgtgctggcggatttgaaccacttagcaaagttcctgatgataagtatgttgttcttggtttaattacttcaaaatcaggtgaacttgaagataaggaagcaattatcaaacgaattcatgaagccgcacaattccatccattagataagctctgtcttagtcctcaatgtggctttgcatcaactgaagaaggaaatattttaacagaagaacaacaatggaagaaggttgcacttgttaaagaaattgctacagaagtttggggataatttcaaatgaataatagcagggactcaagatacttttgagagttcctgctatttattcttctccaactaaagtccccaccttgggtagatttgccaatacgcggtctttatggggagaaaccttatacagtgcatccgttaaatcataaccggcttgatatccatgatgaatcccatttttccaagcaggactatgagtcacatcgtaaacaattccatcgattgcaatatatgcagctgctccattctgtccattatatttacgcaactcatctctggtaaatgtttgatttgccatccaacctactccttaatcagctaatttcccgacaactgttaacttttttagaatttcatctttttcttttgaacggccaaaaacgacttccattaactcttttatgctgattccttttttaggagcatctgtaatgtcataaactaacccatcaattgccatgtaatgtggtttttcgccatcaccattatatttagctaattcatctcgtgtaaattttttctcagccatgagttgttcctcctaaagtccattattattttaaatataacactattatttaataaataaactaaaagcactccaatgactagaaatacaataatttaattttataaaaaagactaagataaacccagtctttcttacactaattgtcctactaacggtaatttggccaacacccgatctttatgcggagagtaattaaacagaacatctgtcaaatccaatcctgccttatttccatgatgggtaccatcttgccatgcgggaatatgagttacatcatagacacgattattaattgctacataagctggattcccgttttgcccatcatatttttttaattcttctcttgtaaatgtctttgccataatattctgcctccttatttgatagtgtcagttcaatatcctcactatatcatggaagcgcacacaacaaattaataattatcttactttaacgcaaaattactactctattagtattttcttcacaattaatccaataccatatctaagtgcgggatattatcttcaaggtaaacatctgaaatcggcttaagtccaaacgatgcgtaaaattctttaagatatgcttgagcttgaatttgaattgtcttatttgggaaaagacgcttagtttcatcgatcgttgcctgaactagctgacgcccgtattcatgtccacgaaattgttttaaaactaatacgcggccaaaagtcgcatgagagctatccttagccataattcgcgtataacccactaattctcctcgctcgtcctttaacattaaatggtgagcttgataatcctgttcatcgatttcttgataaggacattcttgctcaacaacaaaaacccttacccgttcttctgccaatttacaccattcttgagctgtcatttcgtttaatgtttttacttcaacattcatattaaaaacctcctaaaaaataaaagagtactaaccaacttcttcatgtcattgtgacaggccctagtagaagatggctagtactcttaatgtctttaatccggggactaaagacgagtcgttattaaattattcggtatcggtatacaatgaattaatctatcttgcaattagcgatttaataccatgccggtttatccccgtctgtattgggtttattcacaccaaagttttttcgtgcatacggtgccggatcatcaatgatttttgctacaaaattaccaatcgactttcgcgagacctcggtacctttgaacgcttccccttttgcagtcgtttcgtaatctacttcatccttatctgttaaccatgctggtcgaatgatcgtgtaatcaagggttgaattttcaattacatcggcagcactgcgataagttcctaaatagctatcttcttggccgccacctaacatctcattattccactcaccaaatttacctggaacttcatcatagattccaatcgaagaaatccagactaatggctttacagcatatttttccattaagctgacaatatttttagcttgttgcgtaatttcaggattacgtagattagcataaaccacatctgcccgttcaattgctggctctaaatcaccaatatttaggacatcccctttaataactgtttcgcgattttcatcgacaacattcatattttgtgggtgccgggtaaatagtaataattcatcattaccatttgctaacaatgcatcaattgcgtgtccagcaatttttcccgttgcacccagaatcaaaacttctcttgccattatttctacctcctcataaattctacttttagtatacaattctctgtaccaattaaaagtaagtacatacaagtaaggtagttacattcaggtaagatataattgatggacaagtaatcagcaaattttattttttattatattttttgccccactggttaattgacctaattattggtaccaaactttttcctacttctgtcaatgaatactcagtcttaggcggcactgtcgaataaacacgcttttgaataatgcttgcttcttctaaatcctttagttgaagagccaacattctctttgaacaatctggaattaatttttgcaactccgaaaaacgacaaggctcatatttactaatttgatatataattacgcttttccattttccgtttattaatttaagcgtattttcaattggacaatctttttcgaccattttttctcctttctctggtgaaataaaattcacttcttgtatatttttatctttcaattactattagtaagtaaataaatgtacgggagtgattattatgaattcacaatttaatagtttatctgcaaatcgtcgttcaatctatgcgcttggtgataatctttcacaaacaccagaagaaatttttgacttagtgaagcaaacagtcaaaaactcaccaactgctttcaatagtcaaacagtacgggcagtcgtattatttggcaagtcatcagacaaagtatgggaaattgttgaggacgctttacgcaaaatcgctaagagtccagatgcttttgaacaaacaaaggccaagattgatagtttcaaagctggttatggaacgatcctctactttactgacactacaattgtgcaccaattagagaatgattatccatcatatgcagctaattttgcaaactgggctgaacaaggacttggtggtgctcaacaagccgtttggacagcactcgcagagcaaggaatcggtgccagtcttcaacattataacccattgattgatgatgcaattcatcaagcatttaatcttccagctgattggcaattgcgtgctgaaatgccatttggttcaattgaggcaccagctggggaaaagactcatcttgatgacgaagagatgttcaaattaattaagtaaacttatttttcttcatcctcttgaacgttatataattattgtaaacgttaaaggaggaattttaatggaacggcaacctaaaatgtataatactggagcagactacgctctagcaatcatcggtggtaaatggaagtctgtcatcctctatctcttagctggtcatccccgacggacaagtgaactagttaagcaactaggcacctcatataaagtcttgagtgaccagcttcgtgaaatgacagatgccggcctcgttatccgtaaaagtttcaatacaattcctccgcacgttgaatatcgcttaactcctgagggtgagaacctttatgccgcccttcgttatttaaattactggggcgaaaacagagcaaaacaaactggtgacattaaaatcatgtgtactgacgaaatgaagcaggtcggcgatgatggtttgtgtgtcatcactaaaaaacatcttaatcattggcgccaagaaattgtaaaaagcaaggacaaagacatttctatctaagttcttgcttttttgtgttctttaatctaaacgccaatgccattataaatataatcatgtaacccgcaagaataagatgcgtattcatgataattggaaagctttgaatacttgtttttcctactgagaaagcaccaaaaattttattcattcccgttgttccagcaaaaataaataagcttccccacattactaattgggaaattatccccgcaattgatgcagagtaataattgacgatcgaagaaatactataattatgggttgctttctcgtagtcatcaattgctgttttacgttctgcaccggcaaagctacggataataaatacgccaataaaatatgttggcagccaaaatgttaataaaattccaattgttagcatcactaaattaatttgataagccttaaaatggaataaatggtgggtttgttttaccaataatcctccaaagacgaaagcaaataagtaagcaacaattgtccaagaatacatttttgtgccatacaaaataccaataaagacggtactatacaaggtccaatactgaccacaagcaccataaagcattattcgttgccgtaaatgattgggataatgaagtaatcgccgatggtttacaagcaaggcaaggatcatcgtaatgaggaagattaataaaagagcggttccccattcaagtggtttcccaaagcctaaacttctccctaatcgcaacagtaacattgcgccaagcaaaattaatgctagtaagtaattagccccatgtagacgaactggcagcggacgaattgcatggggtgtttcccaaattgatcccattgcacaaaaggtaatgattaacattaaagcaaaactaattactggcttctttatccacacaattattccaacaccgatcaaaactataataacttgaaaaagtggtttaagatgatcctgtttaggcaatagcccttgtttcattaatcgccttcgctgacttattgcggttgggaataattgagaagcaatccctgcccctacacctgacaaatcccagaagattggttgaaatccaccaaacatccctaaaaagtaaccaataattccgctataaagaccaatccaggccagccgttgataatcgtattctaaatcacggcaaaataataaaattgtatgccggaaagcatagaaaatagcgaaaggcaaagcaccaacaaagacatcagactgctccttagtaagagaaatatacagcagaaaaggcattaaatttaataataaactacagacaccagtcaatttttctaattttttcatttttattacctctaatgctggtcaattgcactattcagtttctttcgatttactagaaaaataataataactaacgggacaataaatagcattacgggataaaaatatttcacgggtaacgtactatcaataattcccccgatgattggtccaagcgtcattccaatatcaagaccgagaaagaatgtcgaacttgctagccctcgttcattatctggagctagcatcattgcagttgattgacaaacggaataaataataccatagccaaatgccattccagcggctgccagcgccatttcaatattatttttcataatacttaacataataagataaaagattgttgcgaccgtgcttaaaattaaccagggttcaaaacgaacagtatcaaattgggtccgtaagaataaccggctaagtaaaagaacgacagcataaattaagaaataagcgccgacagcgatagataagtgccgttgttcagcatattcaacaatatctgcctgcgttgcaaaatatgggatagcaaataaagctgttagaagagcaactggaatagcatctcgctgaataattttaatatggaggccactttgttttacagagtgtgttaccggttgggcacgattactgacaaactgtattgtgacaacaactagtaaagccgataatgcagaaatcaccattgcagctcgataaccaataactttatacaagttaattgatacagcaggagcacatgccattgccaaagcattcattagtccataaaaactcattgcttcgccaacatgattaaaggggaccaaatatgatagccatgttgtcatacaaaccgtacataacacaaatcctaacccgttaatcaaacgacatattaacaggaaagtgctattaggcgttaacacataacctgcaaccccaataaagcacaataatccaccccaaaaagctaatgaatatttcgaaaaacggtcagtcagattaccagcaattggtcgcaaaaacattgaaacaatactcatcattccgacgattattcccgcaaaagcacttgatgctcccaaatcctgagcatatccgttaatcaatgggttacagtacatattactaaacataaaaaagaatgaggctgccattacgagcacaacatcctttgtaaaaatcgatttttccttcgccatcaattcccctgctttctttgcatgatttcaattaaattctaattactatcatacaactatttgggaaagttaaatgatttcccaggaaataaataaagagattgggtgttgtttcccaacctctctgtgtgtacttcactatttatattttactgcaaagaatcccaagctggtagaataacgggttcactgtcagctactttctttactcgatcgctaaggtacttcttattaataacagcttcataagtatactcttcaaaccaatcttgggtcattacaaagtatccgttatcaccattatctttaccccaactgttttcaatcttccatcgtgtaggttgatcatttaccatgtcaaagcctgttaatgtcattgcatgagaaacaacggcttgcttagtttccaaacgatgcttcttatccattacaaagtcaacatcaagcaattcctctcgatgatataattttgcatccatcaaacctcgcttacggtccatttgttgaagaacatcattcccaacccaaactgtttcaccagcttgcaattgtttgatggctccttcttgtaattctgcaaaaggaacattaacaaatttaattggcaaaccaccaaccacactatcttgagctggcattaaataactccgatccatttcatgatcaggagcgttagtaactacaacatagtcacttaagtttgtatcaaagtattcatgatagaactttaatggcgttaagccaagaacttggtggaactttttatcatcatcccgatattcaagatcaaattttgcaggcggttcaccaaatgaataagctgcaatcttataaacgtcacccatcattcgttcttgtgcttcctgtaattccgctgcactggcattcgtttgcaccattgcccgtaattcaattgcatctttgcgcattaaactatcaaatacttcggccacatctgaagtatccttcgtattatgtgtgtcaggcattacatattctggaacaacaccatatttttcgataatagaagcagcattcgcccattgtccaccatcatttaatgcgaaactaagatagaaatcaacagttcgatcatgcaaaggcttatcagcagttgcaataatcttttggaaaaacatatttgcccgttcaattcggtcccagaaaaacagataattttgtgataattcaaagtccttgaacttatattttgttgcaaacttatgacgcaatgtgtttaatgctgcaaaagaccagcaacgcccactatgacgctggttggttggcttacctgtcttgatttcataagaaaatgctcgatgaagacgttcgcttgccgttggatcttcactcgcagctttaatcccatttttttgtattgcccgggcaataatttctgcatctttacgtgaatgaaattctttctttaatttttcaaccatttttgaggttaaatcgtgttcttcagtcacaataaatcccttctttgcctaaaattctaaaatgacttatacactattaatgataccgcattttaggcaaaattattgaattaaagctttgattcatcattatcctttaccgcttacaaaaaattagttaaaattatatgtaataggtcacttttaattataaattggataaactgcgttaaaattcatctaggaggtcgattagttatgaagaaagtatttgttgtcggcggttcaggccgtgtcgctactgacttaattaaagatttagttgctactggtaatgaagttacagctggtgctcgccatccagaaaaagttattaagttaaaccacgttactgctgtagaattgaacctacatgatagcgttgaaaaaatcgctgaattaatgaaagacatggatgcagtttactttgttgccggatcacgtggcaaagatttactgcaaactgatgcgatgggggcagttaaaacaatgcaagctaccgaaaaagacggtattaaacgttacattatgttaagttcgctctatgccttacaacctgaaatgtggccaaaagttccatcattagcttcaattatggactacaatattgccaagttcttcgctgataattatcttatttcaaatacgaaccttgactacactatccttcaacccgctaacttaactgaagaacctggtaccggtaaaattcaaattggtgaaggctctgcaacctctaatccgattccagatgttgcccagactttagccgatatcttacaacacgataatacaatcggtcatgttatcatgatgcggagtggcgatacgccgattgaagaagcactggatcaaatttaattttttacagattgtagatcagtcaaaacaagatatggctgatctacaacttttttctattccaaaatcaggtaatagtttagctaattcttctcatcagccgtataataaacattaaaaacaaattaagaagggaatcttttacatggcaaaactcgaacgcttttataatactttccaacctgaccattatgatgtttttatcgatattaatcgagcaaagaaaaccattaatggaaaaacaactatcactggtaacgcgactgatcctcaaattgcaattaatcaaaagaatttgcaggtcaccagcgttcaagcagacggtcaagaattagactttaagattgataatgatgccgaggcagttcggattacccttccgcaaactggtaaagtaacttttactgtaacttataatgctaagttaaccgattcaatgatgggaatttatccatcatactatgaggttgatggggagaaaaagcaaattattggaactcaatttgaaacaacttttgcgcggcaagctttcccctgtgtcgatgaaccagaagctaaagctaccttcagtctagcaattaaatttgatgagcatcctggtgaaaccattatcgctaatatgccagaagatcacgttgaaaatggcatccactactttgaacccactgtgcgaatgtccacttatcttgttgcctttgcatttggagaactccaaagtaaaattactgagacaaagggtggcgttaaagtaggggtattcgcaacgaaagcgcaccaaccaaaggaacttgattttgcattagacatcgccaaacgatcaatcgaattttacgaggatttctatcaaacgccgtaccctcttccacactcatggcagttagctttacctgatttttctgccggtgcaatggaaaactggggattggtaacctaccgtgaagcttacttattacttgatccagacaatacttctcttgaaataaaacaattagttgcaactgttatcacacacgaactagctcaccagtggtttggtgaccttgtgacaatgaagtggtgggatgacttatggctcaatgaaagctttgctaatatgatggaatatgttgccgtggatgctctccagcctgactggcatatttgggaacttttccaaacttcagaagctccaatggcattacaacgagatgcaactgatggtgttcaatccgttcatgttgatgttaacaatccggccgaaattgatgccctattcgatggtgcgattgtttatgccaaaggatcgcgaatgttagtaatggtccgggctcttttaggtgacaaagcgttacgagaaggccttaagaattattttgctgctcacaaatacagtaatgcaaccggagctgacttatggaaagctcttggcgacgcatcggggcttaacattggaaaagtcatgaattcatggcttgaacaacccggttaccctgttgtaacagcaaaaattaatgatgatggcgatttagtattgttacaaaagcaatttttcattggtgacggtaaagatgttgatcgtcaatggcaaattccacttaatagcaactatgatgaagctccacaaattatggctgaacaagaactcaaccttggcaattatcaagcattgcgcgataagaatggtcaaccattccgtctaaacctcggcaataattcacatctcatcgtaaaatatgacgatacgctattaaacgatattttagatcacgctgatgaattagatccgattacccaacgtcaacttcttcaggatctgcggttacttgcccaaggccaacaagtatcttatgcgtcattaattccattattaaagcaatttaaagatagttcttcggcaattgttaacgccgaactataccaaattgctaatagccttaaaatgtttgctaaacctgattctcctgctgaacaagaactgcgacaattctttgatttattaagcaaggatcaggtaaagcggcttggctggttacctaaagatggtgaaagcaatgacgatcaattaacgcgcccttacattcttagtgcttcactatttgcacgcaataatgattcaattactcaagctcaccaaatcttcaccgaaaatcaagataaattagagtccctttcggcggatattcgtgggttggttcttaaaaatgaagttcaaaacttcggaagtgctgaattattcgataaattgatcaaagcttaccaacaaacggcggacgcaagctttaaacaagacttgcgaatggcaataccaaatacaaccgatccagcattaatcgcaaaagttgttagttactttgaagatgctgacatcattaagccacaagatttacgagcatggtatcgcggacttcttgccaatcaagcaggtcagcaagcggcctggaattggcttcgtgatgaatggcaatggttaaatgacacagttggtggcgatatggaatttgctacctttatcactgtaactgctggtgtcttccatactccagaacgattgagcgaatttaaggatttctttgaaccgaaacttaatacaccaggtttaacccgggaaattaaaatggacattagcgtaattgaaagcaaagttaacttaattaacaaagaacaaacagccgttaatgatgcaatcgctcaacaataacgaaattaattaatagtaaatttcacctattttgttgattcgtgtttagacttagcatatattactactgttggggtaggaatctcagagttattgtctaacggaacggaatgtgaacgttaggaggaggcttataactagctgctttgttattccgcattcaccatgaacggaaacgtcaatgtgttccctaacaaaattttcaaaagggagtggattgatatgtctacgttatcatttgccggaccgcgttttactacaaagaatttaactttagctgctatgctgatcgcactgcaggtaatcttaaacaaactttcaattggagatccagcggttttaaaatttagttttggttttattgccaccgcacttattggctactgtcttggaccatggattggtggctggtcaatggtcgtatctgatatcataagtaatactattttaaattcaggaagcttattctttcctggctttaccctctcagcatttatcgctggtgtaattgcaggaatgttcctataccaacaacggataagctggcaacgaattttaatatatgagtttttccaaattcttcttactaatgttatcggcacaactttatggctttaccttatgagcttaagttccagtagtaccggccatactttcatggctcttctcttcattcgtttgccaaaagagttgattacctggccgattgaaaccttgcttgtactagttatcctgcggcaattatcacgattaaatttaattacaaaaaagaatgaaaaataaatttatttaaaaaagtattgcattttaaatgaattaggttaaaatacaattaacaaaataagaaaagcgatgagaaagaagagtaactagttgtattcgttcagtgaactggtggtagtgagaaaccagtcgaccctacgctagtgaataacactttcgcgagtgctgccaacccaaataggtttacttaaagtaggcttggccggatccggaccgttacctcaccggcagagcatgatgtgctcttgaggaggcctagttttatactagacaatttgggtggtaccgcggaaaaaagcctttcgtcccttgattataaggggaacgaagggcttttttaattcattcctaaatctattattttaaggagtgtctattatggacttaactattccaaaggattacgatccacgtctttcaattagagaaactgaagctgctattcgttatattcgtgaaactttccaagacgaatttggtaaagagttaaaccttcaacggatgtctgcaccaatgtttgttgaaaagagtactggattaaacgataacttaaacggtgttgaacaaccagtatcgtttgaaatgaaggatatgccaaacgaaactgttgaaattgtccattctctcgctaagtggaaacgtcttgctcttaagcggtacggttttgggatgcatgaaggtctctacaccaacatgaacgccattcgtaaggaagaagacctcgataacttccactcaatttatgttgaccagtgggactgggaaaagattattagtaaggatgaacgaacagaagaaaccttaaaggatacagttcgtgatattttcaaagtgattaagcacatggaacatgaagtttggtacaagttcccgcaagctgtttaccatttaccagatgagattcactttgttacaacgcaagagcttgaagatcggtggccagacctcaccccacttgaacgggaagataaaattgctaaagaacttggtgctgtttttgtaatgaagatcggtgacaagttgcaacgcagtggtaagcctcacgatggtcgagcacctgactacgatgactggagcttaaacggtgatattattttctggtatgaacctcttcaacgccggatcgaagtttcaagtatgggaattcgggttagtccagaatcaatgaaataccaacttgaacaagccgatgcaactgatcgtgaaaaattaccattccataaaatgttgctcaatggcgaattaccatatacaattggtggaggaattggtcaatcccgtctctgtatgctccttcttggcaaagctcatattggagaagtacaggcaagtatttggccagaagatatgattaagaagtgtgaagaaaaccacattcaaattctataatttaagggagagtataaaagtggaaactattacaattagtgaagtacctaaacatgttggggaaacagttaaaatcggtgtttggttaactgataagcgttcaagcggtaagattgcattcttgcaactccgtgacggaactgggtttttccaaggaatcatccgtaaaaatgatgtttcggaagaaaaatttgattctgctaagcacgatttacaccaagaaaccagtttttgggtaaccggtgaaatcgctgaagacaagcgttcaaagtttggttatgaaattcatatcaaagactttgacattgttggcgaaagtgaagactacccaatcggtaacaaggaacatggaattgacttcttgcttgataaccgtcatttatggttacgttctcgcaagccgtgggcattaatgcggattcgaagtcgtgttaagcttgcaacaatggaattcttcgaaaagcatggatttactcaatttgatgctccagaactaactggaagtgctcctgaagggacaacagaattatttgaaactgactattttgaccgctctgctttcctttcacaatctggtcaactatatgcagaagctggtgccatggcattaggtcgcgtctacacgatgggtcctactttccgtgctgaaaaatcaaagactcgtcggcacttaatggaattctggatgatcgaaccagaaatggcttggatgcaccaagatgaaagccttaagattcaagagcaatacattgcttacttggttcaagacttaatcgaccactgtgcacgcgaacttgaaatggtaggtcgtagtgtagaaagtttgaagccatttactgaattaccatatccacgaatcacttataaagaagcaatcgaaatccttcaaaagggtggctttgatgtcgaatacggtgctgactttggttcaccagaagaaacctacttggcagatcaattccaaaagccagtatttatcttgaactatcctaaagaaatcaaggctttctacatgcctgaagaccctgaagattctcgccaagttatctgtgcggacttgcttgctccagaaggctatggtgaaatcattggtggttctgaacgttcttacgattacgaatacatcacaaacaaacttgaagaaaacggcctaagtaaagaagattacggttggtacgatgatttacggaagtacggttcaattcctcactctggatttggaatgggccttgaacgattcttagcttggattactctccaagaccacattcgtgaaactattccattcccacggatgcttaaccgtttgaacccttaataacgaaaaagggactgtgacataagttaagttactttcataaaaagcaaatacgcagtacaacaatggcctctaatgtccggcaaagccgaacgttagaggcctattgttgtttgcgggggctcgaaaacgaagtcacaagtgacttctgtctcgctcccttttttatatacttttttagaacttaaattaattattcttcattaaaatatgctgtgccttttccccaataaaatccttgttgtaagataaccggatttccagcaaattttttagctaattgtcgattcgaaattccttcaataacaaaggtaagatgatgttttttcgcaaaagctaaccacgcattaacaaagctcatcatcagttcataatcttcatccttaaaaagtaatagtgataatttgattcgactaacaacctttaactgccttttaatgaatgcatagctattactacccgcacacacatcatcaatcgccaattcaaaccccactttcttaagacgttggatttctctatctaaataatcaagactatgaatcgtttcgcggcgttccgtaatctcaatggctacgtgatcgtgatatgcttcgcgaatctcttctaaaaatcgccaaatactttcaaatttcatttgacatggttctaaattaatatatattttgcgatttttttgctcgtttaaagcattttttaatgatttacggcttgccttaatccatgcatcgttaccctcttgtgttgtgaggctgtgcaagaaattaattcctggaaattcgccattattatttcgaataagcatttcataagtgtcaatttcagcattcatcgcttgatcaacactaaggattggctgaaatatattgtacatttttatccctaacttttaataattgttatttattttacgttctaaactaggcttttggggacgttgatgatgctgatcagtaacaatccatccacggccattgttctttacactatataacattttatcagctcgcttcaaggtcgtgtcaagtaattcatcattcaaacgatcagttaaactgcatgaaaagctaattgttaatttcattccttccttggtaacaatcgatttattattaaagaatttttcaatcgactggagtaattgatagacttcttctagtgaatggttagaaactacaatagtgaattcctcacccccgaagcgatatacataaccatgcttgggaaatgcggaatgaatttgttcgcgaaaaactgttgagaaataatttaacacttcattaccaacaaagtgaccgtatgtatcatttatcttcttaaagtgatcaatatctaatgccccgattacgatattatggatttcattattattagctaatcgattaatttcttgactaagagctcggtaattaagtaaccctgttaaatcatcacgttcactttctttttcaagaagctttattttttgctcatttttcttttcactataaaaacgctgatcttcaaacatcgcaataacaaataatcctagtgtggctgcagcaatacttacaggagaaaaactgcgagtaatcgcaagcgatactaactcgactattcccaacgatgcaatggcataaaaataactaattctttttgaaattttacaccaccgcgttaaagccaagcaaattgttgtaaaaacaatcgattcaacgatccaataccaccaatcttttagtggtaaaatccccatcaaatattccacgacattcacaaataacggagttagagctaataatgcccaccatattttgtacactttatcgcgaaaaagcattgtaacagaaacaacttgcatgaaaacgacttgtccgatattaaataaggacaactgaaacaggcaaaattcctgaataaagtaagttattataataacggctcctagcccccaactagttaaccgtgaattcttatacgaaacccaataccgttcaaaataaatttgactgataatcatacaaataacgattattggtaaatagagtatcgcgtaaaaaaatttaagcgccaactgattttcaccttttcaaaatttatttttattaatagctttaaaattgtacttcttatagctgaattaatctagtagcgcttctaatctttcatttaataatattttcctaaaagaaccgtatgatataatttttctgctaacgcgttaagaatattaagaatattaagaagggacgacagattttatttttataatgaaaaataattaccatgatatgtattttgagcatcaccactggctcttaaaaattcgacaaacactacttatgctccttagttggtgcattttccttatccccattattatcactacttcaacctatgtggcttaccagactaatggtcatcacggatactttttctggtattatgctgaaggatttcgtgaacttaattttttagtaatcattttgctatttgctttaggaatgattggggtcttctgcattacaatgggatatatccaagctcaaagaactcgtggactaactacaaaatggcccatgtttgacattaacaaaagtcatttacaacgccaacgagctgaatcattcatgaccaagcagtttggtgatcctgaaatgcgaacaaatacgcgcaattttgttgttaagcctgaacaaaatttaaccaagaatcaattacgcgatattgttaacaatcacataggagatgataaagatggtttctaacattttctatgaagcatttcaaaccagctcaccatggatggtctttcttataataatcaatttaattttatgtatatatcctattttaggagcgatgttctggttctttggcgcaatatcatatattctctttcgccaaaaagaagaattaccaccaaaagccgaacttacccccgaaccttttatcacgattatgattccagctcataatgaagaaattgtaataaaaagtactttagagtatttattaacccaattgaattatcacaattatgaagtgctggtaatggatgatggaagcgatgatcgcacccctgagattcttcattcaatgcaaacaaaatattctcgcctcagagttattagaatcgaacaaaatcaaggaaaggcccatgcatttaatattgggcttttctttgctaagggtgaatatattttaagcaatgatgctgatactattcctgaaactgatgcactgataaagtatatgcaatattttacaagtgctaacgggattaactatgctgctattactgcgaatatggatgtttataatcgttcctcattatggggtaaatctcaaacggttgaattctccagtatcgttggcataatcaagcgaagccaaactgccatcaataacacgatgtatgcatatagcggtgcaaataccatgtatcgacgcgatttccttattaatgttggtggttttcgccaagatcgtgcgactgaggacattagcattgcctgggaccatacattcattaatgctactccgaagtttgccccagatatcgttttccatatgaatgttcctgaaacgtttcacgatttatatcggcaacgtaaacggtgggcacaaggcgggtcagaagtttggctttctaattttctgaaagtctttcgccatccgtggcaatatcggtttgtcatccccatgctaaccgacacaaccttatcgattatttggtctttctttttttggataacaagtatcatttttattattacaatgctgtcttttgcaataactggtaactacgaacgggtttggcacggcatcgttatgagtatgatctttgttaactttcaattaatagccggtctttttcaagtgctggcggcgttaattcttgattttaatggatctaagttacgctatttaatgttttcgccactttatctcttatttacctggatcgttaatcctttaacaatcgttactacatttcataaagcgataaaaactgttactggtcatggaagtggtaaatggattagtcctgaaagaaaggtagttgataataatggcaagttttgaaacttttctttggtggatatttattatctttaccctaatttgtgggggcttttgcattgaggcgcactatcgatataaaaataaaaatggcattgataatgaatacaaattttcaaataaatataaatattttggtcaacccgtttatgataaacaaaataaaattcatggttatgaacttttgttacgggaatacaatcagcacactaataaatggcaattaccacggaatgttgtggattttccgctcagtaaaattgtttctacaattcaagaaatcaatccacagttaaaagatatcgcaaacttatcgttaaatatgaccgtcagccaaattaccgattttcgcgctgaatatttctttacttgggtcttaggaacaacaaatattaaacaattagtcatcgaattagatactaatgatattagacgtgctaatatttttaaacgcaaagaaatactacatatgttcaaaaagctccaacatcctcaaattaaaattactattgaaaatgttgattcttctaaaaaaacatacaacttactacagcagtattttccatatatcacctatttaaaattcaatattcattcttttaacaagtcggcaaatcactggatagatatcactcttgcgcagtggcaacggagaatcgccattttcaacattgaaatgattgtcggcaaaattgaagatattaatcaggttgcattagtaaatcaactaaatatccctttccgtcaaggttatgcttacggtcatccagaaaatcataaccacccgtcaaacgggtggtttgcacatcggctataagccgataataaaagccggcgtctcaaggcgctggctttcgctttgctcaagccaaaatgctctgactactttgccaccgctttaagcggtgtttatactacctcacttacccttaaaagggtccgaatattccacacttgttagcttatccattgctatatcatgtttctcttgatctcggatatacttctttatcgtggattcatttaatccaactgtactcacatagtagccttcagcccaaaaatgtcggttcccatatttgtattttaagtttgcatgtcgatcaaacatcattaatgcactttttccttttaagtatcccataaactgcgagacacttagtttcggcggaatacttactaacaagtgcacatgatctggcatcatatgaccttcaattatttctactcccttatatttgcacaacaaacgaatataatctctcaggtctcttcggtattgattgaagatcgctttacgtctatactttggtatgaatacgatgtgatacttacataaccacttcgtatgggctaagctatttaatttattagccatatttatataacctcttttcccttattgactttggcttgaacacctacatcttaaggcaaaagaggccttttttatataatttttatcgcccacccgcatagcaggtggttttttgtttcgtgcactcgctctgctcgcgcactcaactaggtctaaagacattaatttaaaaaataaataagcgaagttggtttttaaccagcctcgcttatttattttagaaatatattcgtattaacaataattttgcgctttagctatttgcgataaaatccaataaccgatacataactcgcttattttcagccggaacgccatgctgaatgatttcttttccattttggtgaagatcattatggtctaatggatattgatcatcatttacagcaatctcgcgaacattatctgctgtcggctcaaagtggaattgaagcccaataacattaccgttcataacaaagccttgatttttaactaagtcactactaaataataagtctgcttgagctggaacttcaaacatctcttcatgccaatgcagagcggttaattttggaggaatatcagaaattagatcgctttttaaatacaccggcgcccaaccaacttctttatgtggtgccttctttacggcataaccgagtgtcttagcgatctgttgggctccataacacgcaccaaaaattggcttacgagcatccaatagttgccgaattaaaactcgctcttgcttaatccacgttaagtcgtcattagggctcatgggaccgccaagaataatcaacatatcagtctcatcagcagtcggcaaattaccaaactgatagggatgataaacgtacatctcatgtccgcggtcctgtgaccattcttgaattgttcctggtccttcatttggcgtgtgttgcaaaacattgattctcatcgaatatcctttccgtcgacggcaatgttgtgctaggtatcgcctgcaagtacctaagatattattgttataacattaaatcatgagcttaacaataatttttattcccaatattcttcatattttcgtgatgctccggttgcagcatcaacgtctgcttcaccattatcttcacggcgaaaaataaaaactggctcttcagtctcttgctgataatcaacagtaacaactagtcctgagaagaaccaagcatccgcaaagttaacatggtaattaataccatcttttgttatgacgattgttgcctcatcgagcgtcgattcaggttcatacccttgcttaggaccatgtttaacattgtgtggttgaattgttttaccataaagctttattccgtctccactaaccaggttatatttttgttggaaccatttgctagcagtatcagtaataattaattgcacttcaatcactccttggatgattcttgcaatagattgatctaataaatctctaagatgtttaattattctaccacaccctaataactaaataacaatgatatatattctcggcatctatttttcttgttttgaacacataagtaatttttgctggtagctttcttctcgatttaattggctaagcattactgctgcaacatctgcacgattcgtacgcggtgctcctggcattttataaccggaagctgcatttctaaccagtggattttcagtcttaggaccatcgaaaagtggacccggataaattaacgtccagtttaagtttgaggcgattaaatggcgttctcctttctcatgatcagcctgattccccttcaaaaatgtttgaaccccgattttatatggataagttacatttctgatagtttcaccagttcccaaacttgataaaacaataatccgtgatacatcagctagtctcattatcttaattaatcgcggcataaaactagcaaataaatcagcggaactatccttaattggatttcccagggcaactaatactgcattgcaagacagcattgcccgctgaagctttgttgtctcctcaagtgttccttgaattatcgttaatttttcttgtgaatttaatttttcaggagaacgcacatatgctaccacttcatgtccttctgatagtgcttgccgaactaattcctgtcccgttcgtccagttgctccaagaataaatagtttcattagttgctaccttctttcttattatccttcttaaattgagcggtaattattagaattaatcctgtaattatcgtatagattagtcccatcaccacagagtttgcaggtccatggttaaagtacataatgctttttactcccctatacatgtaagacatcggaagccaatcagctaatgtactataaaaaccattcaacgattcaggaactgcagtcaataatggcgctgcaaagaatagcagtaacataaaaactggaattgaaattatcccaacccatgattctaccccattaatgaagataatgaaggcaaaagcacatagcgacataaatagtcccagttcagtaaagttaggaatattgacatccaaaatccaagattgtaatgcgggaactccataaccgatcactaaagctgatatcccagcagctattagttgaacaaacaaagctgaaaatttttctttaagcgatttaaatcgaatttttgagaatgcaaatcctaaaagcattgacgttcctaggcttccaagccataccgattgaaagaaatgtgcgccaccatttgccaaatcgccagttttattaaccttttctttttttatggttaatggattagataaattcaatgccattgttgctggaattgatgttgacctattcgctacgttttgtagtaagttagtgctgagtttattgtttaattgagttgtcatctgcgtcaatgcagtattgacttgggttgtaacagttgttcccattccctgattaataataatctttaattctgctttttgtgcattaggtgctgttaaactttgaagtttttctgaaaaatctttagggataacaattgccccataatatttttctcgattcatatcttttaatagctttttttcagagtcaaacactgtccatttaatactcattgctgaagagtttgaagaactagttgcttctgttatttgtttcgccaaattttccccagttactccgctatcttcatttacaatagcgattggcaaatcgttaactttaacatgagttgaaggtattgcagtaattgaaaagtaggctccgataaataaagctactataattggtaaccataaaaatttgttttttaatagttttaacatagcaatctcctcttatttctaataatatcgtcattataaaaaagagggtgttatactagaactacaaaacgctacaaggtgttgcatttttatgaaaaaatctaaaactgagaaaaaaattcaagatgccttactattacttttaaaaacggaaagtattaaccacatcaccatgagccagattgctcaaaaagctaatcttaatcgtgtcactctctatcgacactacaacgataaatgggatattttagagaatatagaacaagaatttcttcataagttagacactccgcatgcaaaaatgatcactaatcttcagctaactactcagtctttacatcctcatcctaatttaagagcactaacaagcttctttaaggtctttcaagataattttcctcttttgcaagttcttatgggtccaaatgccaacttaggctttactaataaattaatgacttatttaatcaacttagaagaaaaatcacatccttacatcccggttagtatccagaaattgaatccagatatgttttcttactatagtatttcctctttgatcggaataattcagttttggcgaaaaaatcaaaattactcaccatcacaaatggcagaatttttctttaaaattcgtatcggtgctattaaagaattccaaaacaaatgaagataaggccaagtgttctgataaaaagaaaaaactcgggactgttaaaatcaccaagtttttttcttatagcatcctctaataaaacttcccaaaacttttatttttcgtcatcttgaaccatctttaagctggagccaaagatttgttcaatcgtaaccggatcacggtggtcaaagaattggctttccttcttgttaagactagctatctttttcatatcatcattggaaagttcaaaatcaaagacatcgatattttcttccatccggttcttgtggactgactttggaatgacagtaataccccgttgtaaaagccagcgaagaattacttgaccattgctcttgccatacttggcagcaatttccgcaattatttcgttggtaaaaatatcatgcttaccttccgcaaatggtgcccatgcttcaacacgaatatcttcactttgcgcaaacttaacctcttgatcttgctggtaccaagggttaacttcaatttggttgaccgctggcttaacaggcattgttaattcaagatcctttagttgatcagcgtagaagttcgatacaccgattgcgcgaatcttaccttctttctgtgcttcttgtaatgctcgccaagcccccattgtatcgccatatggttgatggagaaggtaaagatccatgtaatcaaggccaagtttttgcagtgaagcgtcaatccctgctttagcccgcttatagttaaaatcagacacccataacttagaagttacaaagacatcttcacggtttacactactattcttaattgcctttccaactgcttcttcattttggtaagcagcagcagtatcgattaaacgatagccgacttcaagagcatcggtaactgcttgttcagcttggcttaagtctggaacttggaatacttcaaatccaagggttggcatttctactccgttatttaattttactgttggtacatttgtcataaaataattcttccttcctgtaattaatcgttgtctatatattaattgctaatttacaaattgaaaattactaactttacatggtagtatacaatcagtgcatactattaaggagtagtctaatgatcgacaattacttgcttgaagaattagtgacctttgccagtgaaaaaacacttgctaaaaccgctgaaaaacttaatgttacccaaccgaccgttacccgggggatgcaaaaattagaagacgagcttggaattcaattatttgaccgccaacccaaccgcattatccttactgataccggaaaattagctgctgaaaaagctactgaagttctcgccgtcaaccgcaattttattcagcagcttcaaaattatgctgctcgacaatcagtaattaaaatcgcatcaattgctccgggcccattaattctgcttcgcgtaaaaagtgcatctttctctactcaaatttcgattgacgagaagtttattacccctgaccaaatcaccgcttcacttttaaacaatgaaaattcaataattatcagcgaccaagagattcaaactgatcaaattgaatcgcgttatttaggtgctgaaaatctctatgttaatcttgataaatttatgtaccttgctaattcccaacaggtttcttttaaggacctagccggcttaagttttgtcgttttgaacgatatcggaccgtggaaagaaatcatccaaaaatatattccaaatgctaaatttttatatcaagaagaatgggccgcacttactgaaatcacaaaatattctagtttcccatactttagcactaacataacaacagctaatccacgaccacgtacttcaaaggacaatcgagtcaggctcccgattaccgatgaagctgcaaaaatgacgttttatgctaactaccttaagaaacaaaaaaattctttaacgcccctacttaataaaattaaccaaacttggcctaatttaagttaaattataggcgtttaacttgtttcgctgaaaatccctatttaaaatattaataaaaaaatgaatcatggtgactaaaaatgacgaaaaaattattactcctttcaaccggtgggactattgcctcggttgtctctgatgaagggctagctccaggcgaatctggtgaagaattaatcaaaatgcttggtcggctggaatatgacattactgttcgtgatattctcgaattagattcatctaatatccagccagaagaatggaaaattattgccgaagcgatctatgaccatcgtaatgaatatgatgggatcgtcgtttcacatgggacagatacgatggcttatactgcttcaatgctgactttcatgcttcaacatataaatattccggttgtgctaactggaagccaagttcctatgaatgtgattcttagtgatgcccctgataacttacgacttgcctttgcagccgctgctaactgcgagccaggagtctatattgcttttaatcgtaaagtaatgcgtggttgtcggagtgttaaagttcgaacaaccgccttcgatgccttcgaaagtgtgaatgtcccaccagtaggagaagttacttcagacggcttttccattagggatcaccagcatccccaacctggtaaaagtcaattaaatactaagatcgatactcatgtttcactggtaaagctcttccccggatttgatcctgcgttgcttcatgcaatggctaaaaatggctgtcatggaattgtgattgaagcgtatggtcttggaggaatgacctcgattcggcgaaatatggtcgctgcagttggtgaattaatccaaaacggtattccaattattacttccagtcagtgtctttatgaacgaagcgacctaacaaaatacgaggtcggacgacttgcactactagaaggagcaatcagcgcccgcgatatgacttccgaaagtgccatcactaaattaatgtggggtcttggtcaagggatggatgttaaagaaattgcagacttcttcaatactgatgttgctggtgaagtaactttagattaaacgaataagagacaggatgaaaattttgttttcacctgcctcttattttttgcgtcaattaaaaccagctacggatccagttaacaaactgggtccaccaagactgagcttgttgcttaactgcctgcccgtcttgagaattcaagaattttttcgccttattcatcatatctcctgatgaattctttacattattaatcgtatcagttacgtgcgagctatagtctttacttgaactaattggagcattattaaactgaacaagcgcattgataattggttgttcatgattctttgtttcattgtaaatgtttcgctcttcaagtttctgattaaagattacttgaatttgattttgcgttggggtagttccttgtttcttttgttggttaatttctttagtggtatcaccaaccgcagccatcaacttacccggatatttactatcatccttattagcttcaattgccccatttgttgcggtcaacatttggttagcagattgtgtattttgctcatttaaactaactccatctgccgcaattgctttatagactccggttaaagctgactctccagaaacagctcggttagcgctaacggtaatagtaacatccgtaacccccgccatttgcgcaaccatagcgtactgttgggcagtaactttcgtaatattatcctcaccattaaacttttttacattaactttaatccccgaacctggatcggtggggacaattgctaccgaactaaccatggcagcattagttgtcgaaccattcggattaatatacttctgataatcactggcagtagcggttaacgttgtaaagttatcatcgactgctagtacattatttaattcattcttctcggcagcccctgctccatatacaacatatgatttatttaacgtatgagtctgggtagttgaactgctactcgtactttcactagttgtttcagccgccaaaaccgtggcctggctaactggcactgctaataaagatagtgcaagagtcgaagtaataatgattttggttaacttatttgagcgcacttttttactccttttaaggcaaattaaatttatgttaatgataagaaaaaatccgccaaaatactagcggattttattttctttaccacagtttaattattacgccagtggattgggcgggagcagaaaggcgcttagtcataacttggcttggccgttaattctctccctcgtcttgcagagcttcaccgagttgcttcattcctgccttgatctggtcttcctgagcattggagtagttcaaccggaaggcaccaggctgtggttcacctgcataaaatgggtcacctggtacaaaggccacgttatgttccagacattgcttaaaaagctcaacagtatcttctactccgggtacttcaacccataggaacattccgccttctggatcagtatatttaacaccttgggggaagtatttctctagcccctctgtcattagtgctttgcgttgcccatacaggtcactaatttgcttgacatgtgcatcaaggtcgttatgcttcagaaattctactacggcatactgggctaagttatctgtatgcaagtctgcagactgttttagtaccgtcagcttattaacaacagcttcatcggctaccacccatcctaaacggaaaccaggagcaagcgtcttggagaaagtccccatatagaaaacgtgtccggttttgtcaaacgacttaactgctggcacatgctgccccttaaaacgaatttcaccataaggattatcctctaacacataaacatcatatttagcggctagttcggccagcttttcccgtcgctttagtgccatggttcggccagttggattttgaaagtttggcacggtgtaaaccagcttagcttccggatgagcctttaatgcttcttctagggcatccatcttcatccccgcttcatccatttctacccccacaaagttggcaccatatgatttaaagacatcaagagcacaaagataagttggctgttcgaccagtacggtatcaccaggattaacaaaggccttcccgactaagtcaagagcttgttctgaacctgtcgtcatcaatacattgtctagctgtccggtcacgttttctttttctttgacacgttggagaaccaattcacggagggctgtcacccctttagcggctccatactgcattacttcttgaccacgttcagcaaacacctggtcaacagcttctttcatcgctttgacagggaaaagctcaggcgccggcaatcctccagcaaaagaaataatctttggatccgccgctgcttttaagattacaccgactgcatctgttccatctgctggcacgcgtttggaaaaattaaacttggtcattgtcgtcactcctcgtaatagatatcaggcattaacgttatcaatctattctgcctgagctagctggtttgctcgctcttcttcttttttcaatcgttctttgatgtatgttgcggatgttgctagttttgcttcttcttccggcgtcaagtccagatgcagttgctccactaccccgtcacggccaacgacagctggatatgaaaggtacgtgccgtattcttcacgataattagaaactggcatttcagttcgcgcatcattcaataatgcgttggttaaccggactgctgccgtggcaacaccataattagtgtatttcttcccttgatatacgaggtagcctccttgacgagcacgttcttctagctcagaaagctttaatccccgttcttttgctagttcagtgaccggtttccccaggacgcggactgtcgaccatgccgtaaattgcgaattgccatgttccccaagattaaaaccaacaacagagcgtgaatcaactttcaacgcttcaccaacccgggcccgcatccgtgcagagtcgagtaaggtccccgtccccatcacgtgttcttttggtaatcccgttaatttttggtacattgaggtaatcacatcacaagggttagtaacatcaactaacttaccgtgaaatccattgtctactaacatctttgctaccaagggcacttgggtccgcgtaaacttaaattcagcaaagcgatcatgatctggcgtatcaaccaactttgatttccctagggctgacacgaccacatcacaatcacgcaattggctttcatcattaacagtcaggttagtatggtaaggcaaattggccattgcatctcgtaagtccaaagcatccgcttgcaccttagcttcattagtatcaaataatgcgaggtcatcgacaaagccaccagcaactaaatagtgcgctaccgttgccccaacgtgacccattccgactactgctacttttctcgtcataataaaactccctttctcttttattgcacaactatgtaaaataattaattctagtcggtcacgtccacactcacagtgccgaagccattatcaaatttggcttcccacttgccggcagttaaatgtggtggtaagaggaaagtacctgatgatactagctgccctgcacggaatgtcttcccttgttcttcaagctttctgactagccattgcaatgactttaatgggttgccaagcacttcacttgacatcccactatccacttctttgccatcgtggtaaagggtgacgtttacatttgctgcatcatcaacggtcttaaacacctcatcggttggtcgttcttgaccatatactacatacccaccaacagcacaatcactcatgacactgaatttatttagatctgggaaccagtcagcaaaacgactatcaggtacttccagcgtgccgcagacagtagtcttatgtaataaatcttccatcgaatcactggcgtgcaagtcagttttagcacggaagccgagttcaacttccactaacggagccatcgtttgttctttgagagagagaacggcaggtgatggtaagaagtgggcatcaacttgttgtccatagagcggactatcagaatcaaacatgtcctgggttttcttactagttaaggaaactttatacccgccagttgggagtccctttaattcaacgaaacgatcttgaagggcataagctgtattatcatcgctaacgacctctgcccattcatccattaccagtggtttcttgctttgataagcttggaaaagttcttgagcaaaagcttcttgttcttcatttaaggtaacgtttttatttgcagtcataataatatcctccttaggacctgaccgctgttaccaaattaattatcggtctaagccggtcaggtcatgttctaatttttcttcaatgttaataatgtctgaaatatcactgtctgtcatgaccaccaccacctttaaatatgtctaataaaaaacgccctcctagctctattaagaactaaaaggacgtctatcaacgtggtaccacctttatttacaacacaagggttgcctcaatcaactgcccacaatggcaattaatcggcaagataatggctgctaccagtatgttctactattatttcggcatacaactcgcgagggatttgtcgcaactacctcctaccggtttccaccaaccaccggctctcttaattcagcagaattgacgattctcggtcaacgttttttaatttctcttaattgattattagtagaatatcacgtgaaaatgagaaaaacaagagttaaattagaaaatcattaaaaataacattgtcatggatcattattcacaaaatatgcacagtatcaactaatttgactcttcccacaagaatttaatcaattcacggtttacttgactgttattgtgaagtttactgtgttgggcattctttccatgaatttcaacttcgcggtatgattttgcacgatcactgactaaatactttaatgatttagcagaatttaccggtacatcttcgtccgaatggctgccatccccaacatccccataaatatttaacacggctgtatttttcggaaaggtctgccgtaacccaagtaattcgcggtaggcagagtccattttctctggttcgccggtctttggatttatcttagcattttgcgtctcactttgccctaccagtccattatagtgtccagcaatcgctactaagtgggctacttgcggaaggcttttatcatttacattgtcattaatataattgataatttccaagtttcccattgaatggcccacaaggttaatttgcttataatagtgttgtttttctaaagctaataccacattttttacatattcaccgccacgatgataaccttgcgtgtaatcatcttgatatgcacttaatttattatcttcaaggttaacttccacaatcggattaacggcatttgctggaattgggcggttaaaagttaccctcccttttttgtcaactgcatcaaagaattgtttgagctgcttaatgcttaaatggtatttaaacatcccgatcatcaaggtcaccggctaattttaatccataacgatttttaaaattaatactttgccgttcaacgttttctgataatggggtaatgtatccaaatgacatattattcgcctccgattttcttaatcactttagcaggaacgcctgcaacaacagtattggcaggaacatctttactaacaactgctcccgctgcaacaacagcattctctccaactgtaacgcctggtaagattgtcgcgtttgcgccaagccatgcattttccttaataaggactgccttcaattcaaccccatggcgcttttctggatccagtgaatgatttaccgaaataattgtgacattgggtccgactaacactttatcttctaattcaattccgccaagatcagtaaacatcgcaccactgttgataaatacttgtttcccaattttcaggttagctccgtaatcactacggatcggtaagcgaatttcaacagagtcatctattttttgaccagttacatcattaaggacgtggcgaatttctctttgtgatgctggtcgactattcaattgttgaagtatgtcttgattttttaaagccgttgccgtgattgtcgcaagttcttctttttgaatctctttcattttcatccctcttttgctcaaaattattgtttatatcttatcgaatttttataataatgttaaatacttatatttaatgacatactatagttaaaaagcatattggagtgatcaaaatggaagttcgtgtactgaggtattttatcgaagtagttcaagaaaagaacatttcaaatgccgctaaaagattacatatttctcaaccgacactatcacgacaattaatggatcttgaaaaggaacttgggattactttacttgaacgaggacaccggcaaatcaaacttacccaagaaggttactatttatatgaacgggcacaagagattactggcctcgttaacaaaactgaaaccgacctacaatcgcaaaagatcattagcggaacattagatatcggtgctggagaaagtacagctattcatcctgtaatgacagtaattggtgatattatcaaaaagtatccagatgttaagattaacttagtaagtggtgatagcgatcaaatctatcagcgcttaaataacggtaccttggattttggaatcataatgggaccagaaaagctcctagattatcattcaattaggttgccgcaaaagaatatctggggaatcttagtccgaaaagatcatccgattgcagaaaaggaaaagattactccggaagatctaaagggtgtccctattattacgtcagctcaatctaaagagcaggatgtgtttcgggtgtgggctggttcattgattgatcagtacaactttattggccagtataatttaatttttaatgctcgtctcttagcagaaaccggggcctgtcttgcactaacctataaaaatttaatcaatattactgggaccgaccttgtctttcgtcccttaactcctactgttactgatcaaaataatctgatttggaataaaaatcgtcagctatctaatgttgcgcagcttttcttgaatcgcttaaaggaagggcaatgaatcttgccattacaaaaagcgctgaataactggatttctccagtctcagcgcttctctttatttaaaattaagtgagtcaatccagccatcaatttgacgtgggttatttaagattgctccttggttgaccttagtatcatagccattttcatcgatagtacgttcaacataactttgtgaacgcttatagtttgtcccactagaagtagcaaatagtgctaaattcttcccgtttaaatcaagatgatcaatcaccgtactaatcatccgcggtggaattgcccaccaaattggatgaccaataacaatattatcgtagttagtaatatctggtaaatcatccttaatgtcaacacgactattatgctcgtgttgttcaaccgttgtccgactgctttcatcatgccaattaaggtcagcagcggtatatggttgtgccggatgaatttctactatatcagcatttaacttttgcgcaacttgttctgcaatcttcttcgtagtgttagttgcggaatagtataaaacaagggtctctgccattcttgagggcctcctttatcttaaaacgtggtataaattttaacgtaaaaaagcaatgatgaaaaatgcttataatcaatccttatctatgctttaaaagtattaatcagtagcatgaagatcatatgcatttaataacatttcaccaaccccgggtgcatccggatcgtgcattcccttgcctttatcatgggcccgaatttggtccatttcttcatccgttaattcgaagtcaaaaatatcaagattactcttaattcgtgttttgtgaacagatttaggaaagacaacaattccttctcaacgtctttataactggttttaattttaacactatacatttaacactaagtttcaatttaatgaggacaaaccatttataattattcattttttgcattattacctacttaatataagtattttccattttatctatctcggcttatagtaaaagtaattaaacacaacagttgagaaaggaagattttcatggcaaagaaacaaacagctggtcgcgaccaacttggtgatttcgcccctaaatttgcagaattaaatgatgatgtattattcggacaggtttggtcacgggaaaaggaattaagccttcgtgatcggagtcttctaaccgttaccgcgttgattacaaagggtgcctttgaacaactcccttaccacatgcaaactgctaagaacaacggtattacaaaagatgaaattgcggaaattattactcaattagcgttctacgttggctggccaaatgcttggtccgcattcaacgttgctaaaaaagtatgggacgattaaaaaattaatttaaaacgtgtctttaatggcgcgttttttattttcggcctattataaaattaattaaggatagtgaggtaattaggatggaagaaattaaagaagcctattatgatggggaacgtcctctttatggtctccgagatgcgcatttagtcaatactacttttggtaagggtgaatcaccattaaaagaaactgctaacttaactcttgatggcgtgctcttcacatggaagtatcctctttggtattccgatcacattaaagtaaccaatacaatttttgaagaaatgtcacgttctggaatttggtataccaacgatattgaaattactgacagtacaattcaagcgcctaaagaatttcgtcgctgtgatgggattacccttaaccacgtccactttacagatgctagtgaaacaatgtggagttgtaaaaatattcagatgaaagatgtctacgctactggtgattatttcgggatgaatagtgaaaacatttatgtcgaccatcttgatcttgtcggaaattatgtttttgatggagctaaaaatgttgaagttcataactcacgcttagtatcaaaggacgccttttggaactgtaagaacgtcacaatttatgattctaagatcagtggtgagtaccttgcttggaataccaagaacattacttttattaattgcacaatcgaaagcgatcagggattatgctatgtcgatcacttaacgatgaagaattgtcgtgctttgcgaactgacctcgcctttgaattatgtactaatattgatgccgagctaaaaggtactattatgagtatcaagaacccaattagtggtaaaatcaccgttgatcacgctgatgaaattattatggatgatccccaaattgattcaagcaaaattcaaattatccaaagaaagtagagggtgaaaaaattatggaatatgattttgatacaattctcgatcggcgtcacaccaattctgaaaaatgggatgttaagccgaatgaattaccaatgacaactgctgatatggacttcaaaactgctcctgaaattatggccgcaatgaaaaagaagattgattcaggtgcttttggttatgaatatccgaatgaggaatactttaatgcagttgcttcctggtataaaaccgagcataacgcggaagctgatacctcttggatgcggttcgcaactggtgttatcccttctattactgcctgtgttaattatttaagtcatgaaggcgataatgtcctgttaatggagccggtttacaatacgttttacaattctatcctcaatagcggccgtcatgcttttcctactcagctaaaatatgatcaatctacatatacttattctgtcgattgggatgaccttgaagaaaaaatgagcaacccgcttactacgctgatgattttatgtaatccccacaatcctactggttatgtttggtcgcgcgatgagttaattcggattattaagctagctcaaaagtacggtatcatagttattagtgacgaaattcatggtgatctagtattaacgggcccagactacactcctactttttccttaccagaagattgtcgccaaaacgtggttacattagtatcaaccagtaagacatttaacgtggcggcccttcatgctgcgacgggaatcgttcctaatcctcttttgcgggaacactttacgcgcgcaatcaataaatatgaagtagcagaaccaaacctcttagcaattcctggaacaatcgctgcttatacgcaaggtgcagactggcttcatcagctcaaacagtatttactgggaaaccggaaatatcttgaaaaattcattcgcactaaccttcctcagctccatgttgttcctggaacagcaacttatcttgtgtggattgatgttagtgcagtaactaataacagcactgctttagcacaaaagattcgcgaacaaactgggttaattattaatccaggaacttattatcatggcaatggcagtcagtttattcgcattaacatcgcctatcctcgttcacaagtcaaagatggtttagaaagattagtggctgctcttaatcagtagacgctgagtcaccgaagatcattgcaaaatcccccacatgcaactttgacacatgcgggggattttattaatgatcgttttcaacatttaatacttttttcgagccagcatcaatcttaacttctttaactgtccggccttttttactttaacttcccaaaaggcaaaaaagtttcatatgaaactttttttgcggctcgtgtaacattatttttcagcgatttctattcctgtctgttcacttgattcaagcgtggacagaatatggaatgcgataatcgacaaattaagtacttcttgcttcaatttttatcggttaagtgttcttgaatccactgctgtccttatgagccatgaatattgctgtgttgtacacgtaatagttcaatcgtatggcgaatcttagttattgtttcttcgttttctttattcattacttggccccactatctattattaaggccattatatcaaaacactttcgccatcgattttgcttctgctaatgcattattaagaatcttttgccgttgatcacggtgaacatcggcaccctcaataaaatccttattttttatgttacccgtcaacaaaaaaagaaaaagattttttgttataaaatagtaattgtgatttttaactgaaggaagtggtgcaatgtcgattgggcaaatttttaaccaagtcgtcattattttcttactaatgcttttaggagcagttattagaaagctcggatttctccatccacaatcaattaatgatttaaccaatattacactctactttttatcgccaatcgtaattattaaggcctttgaacagccgttttcgcgatcacgattttatcaattattactattgattgctggtgtctttctgacctattttgtttcaattttgattgcaaaactactttttcataaagtaaaggaccaaaatattcgtcaaattgcaacttatggaagtatctattctaataatggctttatgggcgttccattagcacaagggcttttcggaagtgtgggtgtcttctatgccgtcgcttcaatgattggttttaatgtcatgtcgtggactcagggaattggaatttttcaaaaacggcagcctcatgattggggaacacagttaaagaaaattattttaaatcctaatattattgctattattattggtcttttcctattcattagttcttttcggttgccaaaattaatttctggttttattgattacaccagtccagcgtttactccactatcaatgattgtcatcggaagtaatcttgcaaacctaagtattaaaaatatcaaattaccaactgcactctggggaagtctcttcgtaaggaatattttcttcccgattctaggaacaattatcttattattattgggaattactggtgttccactcttcaccacagtaattcttagtgcatgtccagtagcaggattagtcgttctttttaccttacaatcaaatggggatgcacggccagcaaccgtcttaatgagtatttcaaccattttgagtttagtaactattccattagtctattggtttgctagtctatggtaatgatatatacgatttttgaataaaggattaaatataataagcatttcaaataatagcctccttaatctatgatggaattagatattaaggaggctttataaatgaataaaccatatattatcgtccatatgatgacatcagttgatggacgaattgattgtgaaatgacggcccaattagccggtgaacccgaatactattctacattggacagtttagatgttcctacaaggattagtggacgtgttactgcagaaaccgaattgacacgtggtggtaaatttaatccgcaaaacaaagaaatccttggtaaaactgactttgctaaaaatgcaattgctgatagttataatatcattgtcgacactaagggaactttacaatggggcaaggaaaatggtaataacttctctcacctaattattacgagtgaacaagttacgaaagattaccttgattacctcaatcgtcaaaatatttcatggatcgcaactgggaaagatcaaattgatctagccaaggcaatggaaatccttgctgatgaattcaatattgaccgtttagcaattgttggtggcggaaaaatcaatggcggtttcctggaagcgggattagttgatgaaatcagtattttaattggggctggtgccgatgggcgaaccggtcaaccaagcctttttgatggccgtccagaaagcagtcgtccaatcgctctgcaattaaaagatgttacaagttttgatgatggagcggtctggttacggtatttggttaagtaactgaaatttgaacgcatagggtcctggtaatttactgtgattctatgcgtttgtgctttaaaaacaagaaaacgcaagaactctcgcatatactttgaatatttaaactaaagtaacgaagagtcttgcgtaatgaaatttataaagttgaagtgcaagataaaaaggtatgattccaatatccaactgggatcataccttttattctctagattattgctttttaagtttctttagatagaaaaataagataaacaatcctattactatacatgcgactgctcccggccataaatctgcccgaataattaaaataaacacggcatatgagattagtgctattcctgctaagaaaaaatattgtttctttaaacaatcaatcagccataagattgcacaaagtaaagaagatgtagaagcaacaatattcttattgtatgcatagtatacacaaataatgaaaaatattaatattgcaattatattccacttattctttttcaaaaaatcaatcaaaatcattaaaactccccatgatagtcaaaacaactttttactccgactctaactattctagaagccagtttagcctctaaaataaaatataaagaaaactattccaattaagatcaaaattacagaaactatccatgtgcttggatgaactataaaaagtaataatccatatattatgaacaatagtgcttgcagatataaaaatttcttccctagattactaattaatagtgaaagtccacaaaagattgacatagatatcatgccaaaattgtaatcaaatattaaataccccgaaatgtcaatttaaattagaaaaaagttgaaagctgttcttctgtgacataactcatgaatacttctagtggtgtacgataattaagcgactttcgtgggatattgttgcgacggtgcattagctgagtgactagttcgtttggtaaatggcgaaaatctagctttttgctaagaccgtcacgacgcaagatgccgttattattttcgtttaaccctcgttgattgggagcaccgacttccgcaaaataggtatgaagatcatacttattggctatctctcgccatccagcaaattctttcccattatcaaaagtaattgatttaacaaagtgacgtggcagtttagcgagccattggtcaagctggcaattcactgcttcgtctgttttatgatgaatattaaggacaatcattactttggattgtcgctctactagcgtcattaccgctccgcggtgagctttaccttgaactgtatcagcttcaaagtgtccaaattcatgttggtaatgcgggaaatcacgatatcgttgatagatactgcgtcctaattggccagctttaccacgacgttccacatagccattgggatggcgttttcctttcatcggtagctgtttaacggaaaagccatactgattgcggacaaacatgcgataaagggtgcgcatactgcagctaatcgggtgctcatcacgaccaataatagtatcaggagtccaaccagccttgatttgcgcatggatatagttaacctcgatagttggcagttgggtctgcttccgaccacaacgacgtttatgacgctgataagtctgaagatattggtcgatggttttaccgttattgaggaaacgataaacacgatagatggtttcttgactacgttgaagtaatttagcggcccgataagctttagtgccttgataccaaaaatcagctatgagagttaattcgcgtgtggtaagatgtttataggtcattgtgattgcctttcttttgattagggatactcaaaagtctatcacaaatggctttttattttttctaacttaattttacaaacggcgatattaaaaaaaatacattcagttataaagttggtacaaggattataaatgtaaacttcagtaatatcctttatatctctactacaaaattccctcataaattaaagattgttacatctaatggtcaaggggaattctcaggtgatattaaaacaattgaacaaaattatcctctatttttcaaggcttctcagtctagcttaattaacttacaaaatgttgaaacaattaatactaaaaaacggcttattaagttttccaacaatgattatcttaagtattctagaagcagatctaaagaattaaataatctatataaatcaagtcaataagactgattgtagattagcaactctgcaaaaatttacaaaaactactactgatggaactactgcacttgatgttttaacagaagagaaactaatcaaaaatctcatggcattatcttcaaaaacaattatctttattgcccatcgtctttcaatagctcgaattacaaataatattacagttattgataatggcaaaattgttgaacagggttctcatgaagaacttctcaaaaataaatcgttatattttaaacttatgcaaacacaataaatagaggctgtttttattcaattttgcataacgattaagtattcttagcttatacaatagccatataatctttcaatattgattatataattttctgtctatactttttatatggttaacttgtttaattattaaccatattcttattacctcttttcccttattgactttggcttgaacgcctacatcttaaggcaaaagaggcctttttctaaatcgttacgagtgaacaaattacgaaagattgccttgattacctcaacagccaaaatatttcatggatcgcatctgggaaagatcaaattgatctagccaaggcaatggaaatccttactgatgaattcaatattaatcgtctagcaattgttggcggcggaaaaatcaacggtggttttcttgaagctggattagttgatgaaatcagcattttaattggtgctggtgccgatgggcgaactggtcagccaagtctttttgatggccgtccagaaagcagtcgtccaatcgctctgcaattaaaagatgttgcaagttttgatgatggagcggtctggttacggtatttggttaagtaactaaaatttgaacgcatagggtcgtggtaaattactgtgattctatgcgtttatgctttaatttcttcgcaagttgcaaaacaaaacgccacagaatttttctgcgacgtttttgtctttatatctcatatcgattgcgaataaattctaccagcgcttcaatatcacgtattgacaattctccaacaagcctaaaagacacatgttcttttgaaagcttaataatatctcccacatcaatatatgactgcttatcaagtccttctattttccaatccataagaggaaaataatttttcttaattctctcagacttatttttgtatttgcttgttattctatagtaaaagacatttttatttttatcttctacgatcaaaactggacgccttttcccatctaaaccccaagatacataagcagtataaatttgattagtcctcattaaaaaattcctcaagttcctcttttgtcttaatttctcgaactggaattttcttggatacttctcttaactccaactccgccctttgtcttgatgtcaaagaaaaactaagaggtattttccctgtggcaactatttgtttatacattccatttattacagctgttggggttaaaccaatttcttttataatattctccgctgactgttttaattctggatcaatgtttacttgaactttcgaactcattataatcacctcatgatcatataataacatattgtgattataaataataatggttattatgacatttcctactaagtaacaagagcttcgattaaaatttcttccataaaaatattaagttcgatccctagtattaattgcaacaagttttacagaaaaaatattggctcatctaattgcttaatttgctttataattaatgtaagcgtttcatgacaagtgatttaattaaggagcgaaattatgacattaggaacttaccaacaagttaaagatgccctaaagaatttcggcataactgattatactgtgattgatcaccctgctgctcacaccactgaagaagctgatgcatatatcgctggtcaccaaggtgttcgaactaaaaccatgtttctgaaagggaagaaaaagaatttctacatggtgattatggatgacaaaaaaccgatggactttcatgaatttatggccctaactggagctaaaagagtttcaatggcccgaccagagtatctacaagaacagcttggcttagcaccaggaattgtttcaccatttggcctgctgaataatgaagctcataatgtaaaggtatattttgacaaggacattgtcgacgaaccaattcagactttccatcccaatgaaaatactcatacaatttttattaagacagatgacctgttcaaatttcttaagcagattgattttgaaccagaaattattgatctatagaaaaataggaggaataaccatgagttttacaatgaatctttactacactggtgagggtgataatgctaaaaagtttgcccaggaaatggaagagcggggaattgcggatcaaattcgtcaacaacctggtaatctaaaatacgaatactttcaaccacttgatgatccccatacgattcttttaattgacacctgggaaagtcaagaagcattagacgctgatcatgattcaccgatgatggcggaattagctaaattgcgtgaaaaatataatttacacatgcatgcagaacgctttatcccagaaaaattaccggataaggataataaattcttgcgaaaataagcagctataacatcaaaaaaattctctaagtcctttagtttgatgaagacttagagaatttttatttagcgatttagtgttccatataattatggagaatatcatccgacgttgcctttaattttagataatcgatattattagagaatagcataatcattcgttttgtcttgtaatcagcgacaaagcaactgttatatccaggaatactcccatttgcgcgaataacgtccccatcaaagtagactccaccaaaataggcaacttcttgatgctgcgcctgttggtagtattcattgatcattttgggatctttcagcacctcattatatacaaacttccagtaatcatttggcgatataaaaaggttccctgctccaaagtctgaggaggtcgttacagttacccggtgccaatcaactgttggatccataggttgtggaatttccttttttgaaacttcagaaaagtctttaatttggtgaagatggagcggtttagcaaagttttttcgaatataggtattatagctttgatgcgtttgcttactaataatggctgccaagatttcataatcaacatcttgataatcccatgtatgcgtatgatcatacttgagatgtttaagcatataagcaatttgggctttttggcctctaagtggttcaaatggacgatcattattaatcaagccactggtatggttcattaattcccgaattgtaatctctttactaccgtcaatctgcgggtaatacttacttagcgaagtgtcccaatctaattgctttttttgccttaattggtagacagcggttcccgttacaatcttttgaagcgatgccgtgggaaatagtcgatccgcctttacgatttgatccttattcgtggtttcattattctcaatggtaactggcttcccatctttgccattaactagcatcaccccattaatatgatggttcttcatataatcttgaagttgatgttgcgtttgcttgtcaactacttctgcctttatctttgatggcgtggtcaataagaagatggcaaaggaacagagcgtcaaaaaaatatataagttaacttttttcataattataagtatcccttccaggcatccgttttcaaaaaatatctacctgtattatacaaattttatgcctcatcttacaaagcagaacaaaaatctgatttttcttgctagaacactttaaattcattcgatttatgttaaaattctaacgtcaataaataaaaaccgcaaaaacagttcgtaaatgacgaacattatcaagggagagctagaatgaataacgacgtcgaaaaagttttatatactcaagatcaagtcaaccaacgcttagatgaacttgccaatacccttactgaaaaataccaagatgaatttccagttttagtttccgtaatgacaggagcaatgattttcactagtgaaatgatgaagcgccttaatttcaagctaaacgttgattatgtcgatgtctctagttatgaagaaagttcagaatccactggaaaagttaaattaattcaagatctttcccacgatattaaggatcgaccagttattattatggaagacattattgatactggccatacattaaagtatctcgctgatcttttcgctgatcgtggcgcgaagagtattgaaatctgttccttactcgataagccagaccgtcgtgaagttgatgttgaagccgattacgttggctttaaagtaccaaatgaatttattgtcggatacggcttagactttaatggactttaccgtaatcttccattcgtgggcgtcctaaaacgttccgtatatgaataatagttaaaggctgagagaaaatgttatttctttcagctttctttttggctttaaacacttaaacgcgatatagtacagttaggctaataaaattgataataattgatttttggtaaaggaggggtaatcgttgcttaggctggattggtgtttacggatgctcatggctgccttgtgcggtggaatcattgggtttgagcgaaaaagcaaggctaaaatggcgggaattcggacccatgccttaattgcggtaggggcagcaatggtcatgattatttctaagtatggcttttttgatttactgaaagttacccatagtaattggaacgtcgacccatcacggattgccgctcaagttgttagcgggattggttttttaggcgctgggacaatcattaatcgtcatgatcaaataattgatggcttaaccacggcagctggaatttgggttaccggcgcaatcggtcttgcctatggtagtggtttatacagtattgggattatcggcacctgttgcgttcttttagcagaagttatcggaaaatatctagatcagtttgcactcagacaaggtaaaggattttcctgctttattcaattagaaggaaatactgatgatttgcatgcacttatcactcagttaaacaaaaaatattttgaagttccgctcaaatattcgatctatgattatggagacggaaaaatctcctgtcaactttatggtgaattaagatctggcttcaaagcagaaaacgtctttaccgatctcactgcgctaggcaacattaaaaaagttgagctagaataaaaacataggaagtgacaagatggcttataatttcagaaaagagcagaaagaattatatgtccctggaaagaatcctagcttaatcaatgtaccagcgatgaagtatcttactgtgcgaggacatggggatcctaatcaggaaaatagtgagtataaaaaagcaattgaaaagctctacgctgttgcttataccattaaaatgagcaaaaaaggcacctaccaaattccagattattttgattttgttgttcccccactagaaggactatggtggcaagatggtatcactggaattgactacgctcacaaagaaatgttcaatttcattgcaatgattcgccttcccgactttgttactcaagacgtttttgactgggcaattcaagaggctagcgaaaaaaagcaacttgatttacataacgtagaattcctgtcaatgcaagaaggcctctgtgtgcaagcacttcatatcgggtcatatgatgatgaaccagcaacgatcgacaaaatacataagtttattgaggaacatggtttacaagtagatattaacgatgatcgccaccatcatgaaatttatttatcagatccccggcggacgaaggttgaaaatctaaaaacggtattgcgtattccggtaaaaaacaattaaaaacactattaataggtgaacaaaaaaagcatcagaagttataactacgacttctggtgccttttatgctacaaattaattatttcattcagcttgtacttaattttcatgttttccccagccgaatttttcaaatcgttctttcatctctttaggggtaaacaacctattgctatcaaatgatgattcaatcatttcacaatcatgtttaatatcttgttgtaattgttgggaattctctttcatctaaaacacctcaatatcttttctacttagcatccccgttacatcttcacttcaattcttcgtatagtggggtaaggtgcctaatagctgaatcgatatattcttccatatcatcaacttggtcttttccccgaaatgcaaactttccaagtaagaaacttgtttgtcgggcctcagtattaaactgttgctgaacatcatgattattaagatatttagacagtgacagatgatcagaaaattccatctcatccttatcccaaagataccagtgagtggcgtcaatattatcagcccattctggtactttatccagtaatttgttgtattcatctggcgtactttgtcgttgttcactcttataatgttgaaacatgaggtagacctgtaactgttttttagcaagcatcaccccaatacagggattatattctgctaataatgctaaacgataagaggcccagtaatgatcacgcaggttccagccattcgtccaactctcaacgtgaaccttcgcaaatttacccgttggtagttgactagcgacagtttgatttaccttcttccacacttgccaaactgctttaaacttctcttttaggtctgcaacttcttctggtgaatgagtttctttaatcttcttaaaggaaaattctggctggtcaaagattgcaaacatattttcagttaatgctgtcattttagctcgcccctttttattcaagaatattataactaaaaaaaactaaactacgaatcataatttagcttcattaaaacaaattcagcatcaccatataaaagccagttccgactaagattgatagtggcatatttcttttccaaaggtgaataaataatgttactaagccggcaacgatttctaataatgccttactaggctcagcaaaagaaatattccgataacaatagattactaatactcccatgattgctgctgggaggaatttccctagttcttccaggtaaggtgataattcttttgactggtcaaaaatcagaaatgggataaagcgggttgccatcgtgacgactgcggcgattaaaattgaaataatttgttcagttaatgtcattttttctcctcgtaattaagtaatttaatgaaaatagcgcgacaagcgttactaatgtcactaataggaaagcattcttgttgcaaaatagtaaacaaataattgcaaatactaaaccaatcagagcatcacgctgagttcgggcatttttcaactgttctgtaaacaaaacaatgaaaagcgccgtcattacaaaatctaaacctgctaagtttaagttaatcattcccccaaggagaccacctaaacctgcaccagctacccaactaaaatagttgaacgcggttatgtaaaaataaacatatgagcgatcgaggccagctggtgcttttaacgttgcatttaaggaaaaagactcatcacacattccgaaaataagaatcggctttaactttcccgtattggaatatttttttaacatcgtaatgccataaaaaatatgtcgtgaattaacaagggcagttaaaataagaacagtcaatggctgaaaactctggactaaaagattaccaattacaaattcgactgatccagcaaaaatggtcgcagccattaataacggatataaaaaattaaagcccagtttatgcatatatatcccatagctggcgcctaaaaataaaaagccaagcattaccggactagttttttgaaaagcgtaacgtacttcctttctcatggtcgaattctccctccttaaaataacttgaatttattttaaacaggagtattttatccatacaaggaattaattgtatggattacaatattggagtgattaactatgcccattaatgatttctcccactatcagcttacctggtaccccgacaaaaataagctgacgcgaccaatttataagagcttgcttgaccaactaaaatcagcgattgagcgtggaattcttacatccggaacgaaactgcctccgcaacgcgaactcgccgattatctcgacattaatttcaccaccgttactcgtacttacaaattaagtgcgcaacttggtttaacttatggaattcatggtaaaggaaccttcgttaactcaaatggtatcgatccgttaactgccaattctcctttgacccgtaccatcgaccttggctttgttgcttcctttgagcagacaaaccacctccttgacaatattcttagcaacaccgttaagcaaggcgcctcgcaacttctaacctatgattcaccaaccgggcgtccgattgataatgaggcttttgggcattatcttgactggcttggtgtgagattaactcctactcaacatatccttattacagcgggaggagaaaactcacttacactactgttaatgaccttattttcaagtggcgataagattgctgtcgacgaatttacctatgccaacctgattgcaaccgcgcaactaaacaatctccatttagtagcaataaaaaatgatcaaggcgggatgaatattgaagcattaaaacacgcttgtcaaaacaataatctagctggcctttatatcatgccggaatatagtaacccgactggcgctgttctctcggtagctcgccggaaagaaatcgcaacgcttgtgcaagaatatgggctaaaaataattgaagatgactacttaagttttcttagtaaactcaatccagaacggccacccaaaataatggaattactaccagaccagacttgttacgtttgcagcatgtcaaaagttcttgcatcaggactccgtgttggttatctagtttttccagcacagctagcccagcaagttaaaaatggcttctttaatacaacagtcaaaacgtcaacactcaatacagcaattgcatccatggcaataaaagagcatgtcgtccaacaaatcattcaaaataaagtcacccttgccaaacaagctaatatcctttttgaacaatatttcccgactgctcctacaaaccaattaaccgattatgccttttttcgtcgattaccgcttaaaaatattcaaaatacagccaaaatcgaacaagcccttgctgatataaatatccgttgttttggctctgatcgttttcaaattaacgcttcttcaaatgaccattttctccgtgtttcattgtccgcaaataagtcacttgatgagttagaaacaggacttaaaaaattacgtggttttttgcaaaaatctaatttaatttaaaaagtgatgttaagaatttttcctagcatcacttctactttctgtttaacttatttttttaactgcctcgtgaaccatcttcactacataactctcttccccgccatccaagtttcattcacgtgaatatttttaagttcactatgagcaactgtaaagatatcatcatttaagataacaaagtccgctgcctttcctacttcaagcgttccattatcatcaaagccgccaatcttagcaccatcccgagtataaccaagaatagcttgtggaactgtaattgcttcttctgcgttaacaatatcgtcattagctgcctttctcgttacagccgcataaatactataaaacgggctatcaggttctgcccatggcgtacatggggcatccgaactcaaacctaacattgcttgagaatttaacattgttttgacgcggtaagctaatttaaactgtgctggagaaaggtaatgccgataggattcatcttctgcaaagaaaaagattggttgcgtgactaacgcatagttcattttactattggcaatctttgcaaacatttgatcagtcattaaggaggcatgctcaattcttactgatggcatcgttgttagccatggctccatctcttttgttacatcaattactgtttgaattgctttatcgcccatcgcatgcacagctagttgaagcttattatcacgagccatctttactgctcgcttaagcttttccactgaagtcaaactaactcccatttttcccgatggataaggatcagtattataggccgtttcaccagaaatactcccatccataaagactttaattccagcaacgcggagtttttcatccccgcttggttgcagtccaacctgcggatcaatttcatcaaaaacatagtagatcgaagccttaggaccaaacccttgtttaactgcatcttggtatagttttaaagaagtatatggcttcatccggcccatcatttcaccaattgccacaattccttctttaagatagtgttcggaactattaaccatattagctacgtcattttcataactttgtgccgatttagcccgaataagaagttgcgaggcagctacttcgcgcataaaaccagttggtcgtccatcagcaaatcgttcaattttcccaccaaccgggtcaggcgtattttcatcaattcctgcaagttccaaggctttagaattgccgacagaagaatgacagtcagagcgataaataaagattggttgcgttgttgacacagcatctaaatcatcacggttaggactccgatgttctgctaattttgtctcatcaaaaccccaaccttcaatccacccatcttcgccttgaccatatgcaggagagttacgaagtgcttcttgcatttccttgatactattaacatttggcggggtacaagcaacaccatggagggcatcagcgatatatttaggatgggtatgacagtcaattaatcctggcaaaactgtttgtccttgcagatcaatcacttcgccttcattaggtaaattatcaccaattcgtttaaccgttccatcttcaactaccatgctattaacaaaatgatcctcagtatcaccaacaaagattttaccgttaataaatgtctgggtcataatcctaactccttcatatttatagttattatcctactgctatcttcgccaaaatgaaaccgttttaaaataacctaagttcaaaaaaatggcaggtctgtttgaatgctgattacattcaaacagacctaccatttttatttaattttacatttttccaccgtaaacagggtagatatcaaaatcgccatagtctaatggctttactcgccgcaataggtccatatcagcttcagaaatttcaaaatcaatttcagtgttttccttcatgtgttctggattagtagtctttggtaagacgatcattcctatttgccaatcataccgaatgcacaattgtgggactgaaacgttgtactttttagccatcttttcaattacggggttgtctaaagcagcgccgtgagcaactggtgaatatgcttcaaccgcaatgtcatgttcatgagtaaatgataaaagattgaatggagtatgaccaatatgagctaaaacttgatcaacagcgggaacggtatcgctattcttaataatattttcaagatcggcttttttgaaattagaaacgccaattgttcgaatcttaccttcgttaacggcatcttccatggctcgccaagcagcgagatttccttcaaggtaacgattatcagattgatttacttctttccatggttgaggactatgaataagcatcatgtcgatataatcaagacccatcttttcaagagtctcgtcaatcgactttttagttacatcataatctttgtgttcagcagcgatctttgaagtaacaaagattttatcccgatcaataccggctgttcgtacaccttcaccgactccccgctcattatcataagcctgagctgtatcgatgtgccgatatcccatcttaatcgcattccgaactgcttcggctgcttggtcatcatcaatcatccaggttcctaatgcaaactttggaattttcacaccactattaagagtaattgtctcatctaaaatcattgttctccgtcctttcgcatttcaagttattcctacaaaaccattgtcgtcatttttcccataaatgtaaactagtaagccttgaccagaataataaaaaaagaggttaaagcttaaaattgctcaacctcgtaaagtttgctactcattaaaatgcctgcccatcatataaagggaccgcatttgaccatttatttcagaaatttgtggtaacttaccccattctttgtacccacaggaggtaaaaagatgatagcttgcttgattttcaatataaatatacgcaattacggttcttatatctagatgatcttcaattcgtttttgcgcatatgttaataaatcacggccaagatgttgccgtcgataatcttcatgaatataaatagctatctgtgccgaatgatcataggcgggatgcggataaaaatactcaagagcacaccaggcgattacttggtcatccattgttgcgacccaaattggatgagtactgtcaaactgcataaaccattcacgtcgatcagcaacttcgatcggtgcactctcatcgttgacttgcagcggaatggcttgattaaatatatcgacaatcgctggtagatcatttattgttgctaaccgaatttggtaatccatatcaaagcttccttacagtatttttacccactgattattacttatcatagaagtgctgccattctttattaacgttttcgcgagtcgtttttgtcccagtccatgatggaacttttacaaccccatcaatcttactcttaggtacaaatccccagtaacgaccatcatttgaaacgctccggtggtccccaagaacaaagtattcacctttcggaacttttgtggcaccattattctttaaccaactgttctgaactgagatactacgcagtgtccagttcccagttccggttgttcgttgacttttgctaatgtagtcttgattaatctttttgccgttaacataaatatttccattcctagagctaacagtatcaccaggaagtccaattactcgcttaacataatcggttttaactgatacttgcggatcaacgccattagcatcaaatacaacgacacttccatgatggattttggcagttttcaaacaaaatactcgttcattattttgtaagtttggttgcatggatggtccatcaacccgaacaatttggaagaaaaactgcttaattactaatgcgattattaacccgattagaatgggaataatccaactcattgcttcacgaaatgctttcattataattcctcaatttctttatttaactgttattaatcatacaactagtaataaaacctgaaaagttatttataataaataatatattattttcacatttaataacatcaaaaagatattaagggtcaaaagagagcgagacagaaggcacttgtgacttcgtttttcgacgcgcagctagcctctgggagtccccgcaagcaacaataggcctctaacgttcggttttgccggacgttagaggccattgttgtactgcgtatttgctttttatgaaagtaacttaacttatgtcacagtcccttttaatttttatttcttttcgacaaagtacttttcgaagttcttttgatagttatgattaatccgttgttccattaaccaccgcatgaaattcatgtccttgtcataatggaaagttgttccatagcggccttctttaataagcttttcagcctgctttttaatttcattatttttagcatactgaaggaaagtcttttttgaaaccccaagccataacttgtagttgctttcatccttgttcccataaatcgtctcttgatcttttaagctatcaaaaacgtaatcttcaacggggaaagtagcaagttgatagccatttaatgaaacgaagaaactactacgaccttggcgaggattaaggtcaaataccttgaattggccatcacgacggtcatattttaaatcaaagttaacaaatccagtaaattcaatgctttcaaggaaattcttgatgttgtcatagatttgttggtcatatgctggcataatcgcaacataattaccaacatttgctggattacaatcttcaagaagtgggtgacccaaacacatcatctttaccttatgatctttatcgacataacaattgatggtccgcatattactatcatcaccaggaataaattcttggagaacaaggtcgccattgtatggactatgctcatagataatctccagaacttccgctaatctttctggtgtcttaataatataagccttttcatacccttcaaagtttcccttatgccattgcaccgcatcagcagcctttaaagcaattggaaattcaaatggtgatttatagttcttgtaatcaaggtccggttttaaaatatcggttttaggataaggcaaaccatacttttcacagacattgtagaacttctctttatccgttaatgttgccacttcatcataatcagcatacgggcagaacatgtgctgcgaaagttctttacggtttttcgcaactaattcagtatagtcatccccacaactaattaaaacggtcttcttgccttgcttagcaaactcatctgccgcttcaattaataccttcgtaaacacttctggtgattgtaattgttcgttataatgcaactcgacaatttttgaataacgggttggtgccaatggttgtcgagcatataattgcgacttaatcccatatttttcatacatcgaccgtgccattccgtaagcgttgaaatcactacctagaatcaatggaacaaaaggttgttcactcattagatccccactcctctttatctttctagttcattaatataatcacgtgcaatcttcacatcagttgggtaagggacatcttccccattaactttttgataaggatcttcacctttccctgcaaggactacaatatcatcattttcactaccgtcaattgcctttttgatcgccgtttcgcggtccatttcaaattgaatatgttttactttatcatgatcaatataagaatctatttcccgggcaatagtcatcggatcctcaaaccctggatcatcagtcgtcaaaattacttcatctggttgttcttcagttaaagcttttccaaaccctggacggcgcgaaatacctttatcaccggtcgctcctaagacaactgttactttgccagcattagtttgtcgttttaagaatgccaagagtcgcttcaagctagcgtaattatgggcataatcaacataaattgttccatgggtattactgttaatcatttccattcgaccacggatatgaacatgatttaatgtttctacggcatcgttagcactcgccccagctaatccactggcaatgattgcagcgaccgcatttccttcattataatctccagggacactcgttttataacggccatctaagtttaactgctttgctttctcagttaaggcggtcaactcaaattcactttcatgaagatcttctaaatcatttcgatattcaaaatctatttgggcattgtcaggtaattcgatgtttgctcctcgccgtgcaaataagaaaatgtcttctggttgtgtagttgccttagcagtgtaataaacatcggtaaatttttccgtttctgcattgattaagcatttagcagaatttactaataattgttccttgcagtgaagataatcagcaaaagttgggtgctcatttcgtccgatatggtctggcgaaatgtttaagaaaattccaacatcatacttcaaaccataaatccggtttttcttgtatgcttgcgatgatacttccattactaagtgcgtcatcccattatcaacggcaacgcgcatatcatggaaaaggtctaaggattcgggagtagtcaaatcagatttaaatttatcttccggcttattgcctagaatccgatcaagcgttgaaaaaagggcaatatgatcagctgtactttgggctaaaatatggtcagcaaaataagccgttgttgttttgccttttgttcctgtaatcgcaataatgaacaaatcattttgtggataaccgtaaaatgctgcccccagtaaagacattgctttttgttcgtcgtttacgataatagctggcaatccttcgccttctggatattctttttcagccacatacgcaatcgcacctttttctttagcggatgctaggtatttaggcaaaaaatttcctttacaaaagaataacgttcctgattttaccttccgtgaatcataggacacgctggttgcggtaaaatcagtcaaattactaacatgatccaataaatggtgctcgcgcaataatgctaaagcaggtgtaatatgcaattccatcttgcaaatgactctccttcaatctaatctgccctatattatttcattttttatcataaaaataaataagggttatcaattaacaaaaaaggagacttagaagagtcctacagcccttcgccagcctcctttaatatttttctatgcttctgttgtagccgttttttgtgcgcggtcaattcctgattcatcaggtttgaagttatcaatgaagtataacttataccacgttaagaaggtgtagattgtccaaattttacgacgaccatccaccttaccttcgaagttatcatcggcaagttttagaagtttttcttgatcaaagaactcttttacgaagtcttgttcaaataattcacgcacttcttggtaatatttcttttcccgaagccaagcacgcactggggttgggaagcccatcttaggccgcgtagcccattcttccggtaaatgccggttagctgccatccgaaatgcccattttgtatctttgtagttaaagagatacttagttggtgttgtttcagccactttcattacctctttatcaagaagtggtacccgaatttcaacagagttagccatactcatcttatccgcctttaagcaaatatcgccaggcatgaaacgatgcaagtcaatatattgcttctttgcgacttcatcgatatctttatcttccatcttgtcaaaaagcggattaagaatatcggcaatacttggtccgcaatcaaattctggttgcaagtagtcagcggcttcttcaggactaaaaatgtatgcttggccaataaaagtatcccgtgctggcgctaagttgcggtacatatgctcttggccgtggaagtgttttccatctaaccacttagcaaacttataccggcgttcacgaggcatcttctttagttggtcagttacccaccggataaacttaactttcgtattaaaaccataatcaatgtatcccgcgaataattcatcggcaccttcaccagaaagaagggccttgtagccgttatcctttgctaacttgttcaagaagtataaaggaacaacagatgggttagaatcaggttcatctaggtagtattgaatcattgggaatgcgtggaaagcttcttcgttagtcaacttttcatcagtattcttcaagcccatcttagctgctaattcacgtgcttgtttggtctcatcgtaagtactatcaaatccgattgagaacgtattatctggacgcatcaaagccgttactaaacttgaatcaacccctgcagaaaggaatgaaccaaccttaattcctttatctgcaaaggtatgcgccttaacagaattcttaacaacatcgtcaatcttgttaacagcttcatcaaacgtctcgtcttctggctcaaagttttcgtcccagtattgggtcatttcaaactgaccgtctttataagtgaagtaatgcccttctggaagacggtaaacacccttaaagaaagtttcttgagtaactgggtattggaatgtcatgtatggtttaagcgcttctttattaagttccttcttaaagttaggatgatcaagaaatgccttaatttcagacccaacaaagaaagtaccgttcattttagcgtaatacaatggtttaattccaaaatggtcacgggcaccgaacatttctttagtcttaaaatcccagataacaaagccaaacattccgcgcagcttgttaacaacatccttgccccattcttcatatccgtgcaagattacttcagtatcggcatgtgtcttaaatgtgtgacccttactgattaattcttcacgtaattcttcaaaattgtaaatttcaccgttgaattcaatggcttttgagctatcttcattaaagattggttgattaccagacttaacatcaataaaactcaagcgccggaagccaagtgctacatcatcatccacatattgaccttccgcatcaggtccccggtgaataatccggtccttcatttttttgattaattggtctttaatttgtggtttttcattatcaacaaatgcaacaatcccacacattataaatttcctcttctttctcttaaattcacggatcacaaaatagttatttaaaattcgttattaaaactcgaacctaaattataccatataatgccaaacttaagtatattatccctttgctttaagaaaaccataataaaatctggagagcggagtcattactctgtttctccagattttatttcccgggaaattttacttacgatccttcttggaaaacttcccctgacggacgtaaacactcaagattgcaatatcagcggggttaactccactaattcgtgaagcttgggctaaagtttctggacgaatcttttcaagcttttgacgtccttcagttgctagaccatcaatatcaccataatcgatatcatccggaatccgtttagcttccatccgcttcatccgttcaaccttaacttcctctttcttgatgtaaccagcatattttaattgaatttcaacctgctcaatcacatgacgatcaaggtcctgttctggtgccggaatgaattcggccaacgtttggtaatcgaagtatggtcgcttcaagaggtcagctgccgcaattccatcttttaagcgattatcgccgtgcgcttcaataaactcgttaaccttatcatcgcttggcttgagcttaatttcttctaatcgtttgatttcagctgcgacttggcgcttcttctcttccattttagcaagccgctcatcactaactaagccaacatgatgacccatttccattaaccgaaaatcagcattatcatgacgtaaaattagccgatattctgcccgacttgtaagtaaacggtaaggttctttcgttccctttgttactaggtcgtcgatcatcacaccaatatatgcatctgaacgcttaaggacaaatggtttcttgccttgtgcccgtaatcctgcattaatccctgcaattaatccttgacccgctgcttcttcataacctgaagaaccgtttgtttgtcctgcagtatagagattcttaatgatcttggtttccaaggttgggtgaagttggtacggcgcaactacatcgtattcaattgcatatccaggacgcatcatttctgcattttctaaccccttgattgagtgcacaatcttttgttggatttcttctggcattgatgtcgaaattccgtcaaggtaatattcatccgtatcccgtccttctggttcaaggaaaacttggtgccggggcttatcagcaaaacgaacaatcttatcttcaattgaaggacagtagcgtggtccaactcccttgataacaccagagaacattggagcccggctaagattttcccgaataatggcatgggtcccttcatttgtataagttaaccaacaagataattgttcgctaattggaatataggcactatcaggagtatcaaaactaaagtgatgtggttccttatccccgggttgttcttccgttacactatagtcgattgtctttccattaacccgtggtggcgttcccgtcttaaaacgctcaagatcaaagccaagttcttcaaggttttccgaaagttttaccgctgacttagagttattgggaccagattcatactgtaattcaccgataatgatctttccgcgcgccgcagttccaacagttagtacaaccgtcttagcgtggtaacgagctcctgtattagtaataacacctttgcagacaccatcttcaacgattaattggtcaacagttgcttgacggagagtaaggttaggttcttcctcaatcgtctgcttcattgcacggtgataagcatgtttatctgcttgagctcgtaatgcacggacagcgggacctttaccggtatttaacatccgcatttggacataggtcttatcaatattatgacccatttcaccaccaagagcatcaatttcgcggaccacgattccttttgccggaccaccaacagaggggttacatggcataaaagcaaccatttcaagattaattgttaccaataaggtcttattccccatccgggctgcggcaagggcggcctcgcttccggcatgacccgcgccgacaacaattacatcgtatgatcccgcttcgtattgaacggcatcagatgtttgcaatgcttctgaactcttcattcttctattccctactttcctaaacagaattgactaaataactggtcaagcaactcatcttggtaactatccccagtaatctcacctaataattcccaacaccgggtcatatcaatttgaaccaggtctactggcattccatcattaattccttttaagacatcgcttaaagcatcattagcttggtggagtaaaccaatgtgccgagcattggtaaccattacattattctggttgctttcaattccctcgttgaaaaacatgtgaccaatctgctcaccaagttggtccattccttcatagttaacgattgaagtttcaataacggcactcttgccagctagtaatttcaattccgctaaatcaaccttgcgtggaagatccgtcttatttaagatgatgatccgctgcttatccttggttgcttcaagtaattggcgatcctcgtcagttaatttatttgaactatcaatcaagagaagtactaagtcagcggcgcccaaagctttgcgactccgctctaccccgatcttttcaacttggtcatttgtatcgcggattcctgctgtatcaattaacttcaatggcaccccgttgacattgacatattcttcaattacgtcccgggttgtcccagcaacgtttgtaacgatcgccttgtcttcgtgaagcaaggaattcaataaacttgatttaccaacatttggctgcccgatgattgccgttgctaaaccatctcgcaaaacctttccctgtttagctgttttaagaagaccttggattcgttgttgaatgtccgctgctttttcttttaagagcttcgtagtcatttcttcaacagcatcatattctggatagtcaatattaacctctacctgtgctaatacatccaaaatgtcttgtcgcaaattacgaattaaccgtgacaaatcaccatcaagctggtttaatgcaaccttcatcgatttatctgtctttgcgcgaattagatccattaccgcttctgattgggataaatcgagacgaccatttaaaaaggcccgtttagtaaattcacctggttctgccatccgggcgccaaagctcagtaccaattgcagaatacggttggttgctaacaatcccccgtgacagttgatttcaattacgtcttcacgtgtataagtgtggggagcgcgcattactgaaaccatcacttcatcgacttcttgatccgtatcagggtcaacaatatgaccatagttaatggtatgagttgctactttggcgagattttttcctttgtagatccgttgagcaactttcaccgcatcatccccactaattcggataatggaaattccaccttcaccaaccggcgtcgaaattgctgcaatcgtatcattctcgctatttgccatcgctactttactcctttctaacaaaaaaagtgctagtccatgcatagtaataaaaatatcactaacatggtcaaagcactttcactactttaacgaatattaaatttataaccgctcatattctaagatcattaccagaaattgtcaacaaataagttagtcttggggagcaatcacgatactccggtaaggttcccgaccgtgggagtatgtttttacgtggttattattctcaagttcatggtgaatttgtttccgttcacgagctggcattgggtccataaaaacagcttttccgcttgcaactacttccatcgctgccttttgcgctagattgtgaactgcttcttgacgccgttcacgataattggaagtatcaagttcaacatttacttttgccgctccatggtaatccatgaatatattactaagttgttccatcgcgttgatccggcgaccgtgcttaccgatcacccgtccattttcctcagtttgaagatcaattttgaggtcatgagcttctaaattaataatccgtggctcaacagcaatacccaattccttaaatactgttgttagatactcaactaattctttactagttgcttgaacctttttaagattggcctgttgccgccgcttgatttcagcaggatcgagctcatcttcagcggaatttaagcttgcaggattttgttctggctcttttgctagctgctcgtctttttcttccagtgagggcatcgcaatttctttatcttttattactgcatccacttgcgcttggcgtcgtccaattcctagaaagccgtgccgcggctgttgaagaaccgtaaattcaatcgtttgattaacggttggcttcaattgtgtacgggccttttcttttgcttcttcaattgttgttccagtaaaaactgccatttctatcccccgtgaatttaattaatttccactctttaaatttattactaaataaaaaggctcgcaacaactttacttgtcacagccttaataacttatttccgccgactttggtaagcgcgacgttttgctttttcaatcttgcgacgttttgctttttcagcccgttgcttttcttcacgttcacgacgaatcttaaatggattctgaatgataagcgtttggacaacttggaaggcatttgttactacccagtataaggtaatagctgaagagaatcccaatgccatgaagaataccataatcggcataaaccacgtcattgtagttgtcattgagtttttttcgggcattgaagccatggataaccatgaactaatgaacgtaaataatgccgctagaataggcatgatgtagtatgggtccgggtgacctaactgaagccacaagaaagttccattccgtaaggctgaggtccgccagattgcttgataaagagcccacataactggtaactgaaccagtaacggaagcatcgaagcccatggattaactcctgcttctttatagagcttctgcgtttccatttgcatcttttgcattgactcgcgatcacgtgatgagtactttttctgaattgcctttagttgaggagcaagttcttgcgtcttcatcatggtctttgtttggtagaacatcaatggcagtaagatgatccggatgatgatcgtaaagataatgatccccattccatatccgccaaagtgctttgataaccaaatgataaattgtgaacagttatagataatgtagtggtcccagataccagtactatgactagtaattggcttattggagcaagcagctaaaaatagggttaagctcatgattgctcccaagcttaggaatttttttgttttcttattcaaatcctaatcctcacttttttcatctaacaaatgtgctcgatttaaaacgtgcactaggtttttctttgtttctgccattgataaaccatctgccgctgaccgagcaataaccaagaaatcaacatcagaccgtaattgcggtttcacctctaataatgtttgacgaatacgccgcttaacccaattacgatgaacagcatttccaatcttcttcccgacagaaataccgacacgaaaatgtttttgtcctggcttttccatttgatatacgacaaatttgtggttggccacggaattatgggtttcaaaaacccgttgaaactcactttccttttttatgcgatatgattttctcatttgtataatccccagccttaatttaagtagatataaaaatagggccgggcatacgacaactttaacgattcaaattgctcgtcaagctgactgccctgccccacacaataaaaaaagccactataaaagtggccgtggttatgcagataatacttttctgcccttttgacgccgacgtgctaataccttacggccgttactggtgctcatgcgcttacggaagccatggacacgtgcacggtgacgcttctttggttgaaacgtgcgcttcatacaattgcacctcctattaaattcgagtggtttggtttctagagtctaaaagacgatctcttcaaacatactttggtagtataacacacttaccgaaattaataaacggcgaatttttatttaaatttttttgattattaacaaaatcggcaaaataatccacagcgttgtgtaaattcataatttgtggacaaattatcaacagcgtttttccgagattatccccagattcacacctgttgataaagttatccacaagcagtcttttaggtgttgataactctctagtttactgctgtgtcaatatcatatatcaacacaattctgtggataactggtaactaaatctctttttccccatttttcacaagaatattattaatttacacacagtgttgtgtaaacttttttattattatccacttggttgtggaaaacttctccatgtaatgataaaataccgtttgtaatttaatactttaggaggaaattatt

The invention claimed is:

1. A method for the treatment or prevention of bone loss, comprising administering to an individual in need thereof a lactic acid bacterial strain comprising a nucleic acid sequence having at least 95% identity to the nucleic acid sequence of the genome of *L. reuteri* JCM 1112 (SEQ ID NO: 1), and harboring an identical nucleotide relative to the genome of *L. reuteri* JCM 1112 (SEQ ID NO: 1) in at least one of the following four positions: C in base pair 271 391, G in base pair 453 538, G in base pair 529 228, and C in base pair 599 338, wherein the lactic acid bacterial strain is *L. reuteri* ATCC PTA 6475.

* * * * *